United States Patent
Taylor et al.

(10) Patent No.: US 9,417,249 B2
(45) Date of Patent: Aug. 16, 2016

(54) METHODS OF PREDICTING AND DECREASING THE RISK OF PRE-TERM BIRTH

(75) Inventors: Douglas D. Taylor, Monmouth Junction, NJ (US); Cicek Gercel-Taylor, Monmouth Junction, NJ (US)

(73) Assignee: University of Louisville Research Foundation, Inc., Louisville, KY (US)

( * ) Notice: Subject to any disclaimer, the term of this patent is extended or adjusted under 35 U.S.C. 154(b) by 0 days.

(21) Appl. No.: 14/344,103

(22) PCT Filed: Sep. 13, 2012

(86) PCT No.: PCT/US2012/055166
§ 371 (c)(1),
(2), (4) Date: Jan. 22, 2015

(87) PCT Pub. No.: WO2013/040211
PCT Pub. Date: Mar. 21, 2013

(65) Prior Publication Data
US 2015/0160230 A1  Jun. 11, 2015

Related U.S. Application Data

(60) Provisional application No. 61/535,778, filed on Sep. 16, 2011.

(51) Int. Cl.
*G01N 33/53* (2006.01)
*G01N 33/68* (2006.01)

(52) U.S. Cl.
CPC .......... *G01N 33/689* (2013.01); *G01N 33/6893* (2013.01); *G01N 2333/4704* (2013.01); *G01N 2333/78* (2013.01); *G01N 2570/00* (2013.01); *G01N 2800/368* (2013.01); *G01N 2800/50* (2013.01); *G01N 2800/60* (2013.01)

(58) Field of Classification Search
None
See application file for complete search history.

(56) References Cited

U.S. PATENT DOCUMENTS

| 5,468,619 | A | 11/1995 | Senyei et al. |
| 5,516,702 | A | 5/1996 | Senyei et al. |
| 2004/0266025 | A1 | 12/2004 | Hickok et al. |
| 2011/0144076 | A1 | 6/2011 | Williams et al. |
| 2011/0151460 | A1 | 6/2011 | Klass et al. |
| 2014/0220580 | A1* | 8/2014 | Brown et al. ................. 435/6.12 |

FOREIGN PATENT DOCUMENTS

| AU | EP 1914553 | * 10/2006 |
| WO | 99/09507 | 2/1999 |
| WO | 2007/112514 | 10/2007 |
| WO | 2009/134452 | 11/2009 |

OTHER PUBLICATIONS

Delcayre et al. (Blood Cells Molecules and Diseases 2005 vol. 35, p. 158-168).*
Abrahams et al., "First Trimester trophoblast cells secrete Fas ligand which induces immune cell apoptosis," Mol. Hum. Reprod. 10:55-63 (2004).
Blidaru et al., "Maternal immunophenotypic profile in normal pregnancy and preterm birth," Rev. Med. Chir. Soc. Med. Nat. Iasti 107:343-347 (2002).
Denzer et al., "Exosome: from internal vesicle of the multivesicular body to intercellular signaling device," J. Cell Sci. 113:3365-3374 (2000).
Frangsmyr et al., "Cytoplasmic microvesicular form of Fas ligand in human early placenta: switching the tissue immune privilege hypothesis from cellular to vesicular level," Mol. Human Reprod. 11:35-41 (2005).
Gercel-Taylor et al., "Shed membrane fragment modulation of CD3-zeta during pregnancy: link with induction of apoptosis," J. Reprod. Immunol. 56:29-44 (2002).
Goldenberg et al., "Epidemiology and causes of preterm birth," Lancet 371:75-84 (2008).
Goldenberg et al., "The preterm prediction study: the value of new vs standard risk factors in predicting early and all spontaneous preterm births. NICHD MFMU Network," Am. J. Public Health 88:233-238 (1998).
Goldenberg et al., "The Preterm Prediction Study: toward a multiple-marker test for spontaneous preterm birth," Am. J. Obstet. Gynecol. 185:643-651 (2001).
Gorak-Stolinska et al., "Activation-induced cell death of human T-cell subsets is mediated by Fas and granzyme B but is independent of TNF-alpha," J. Leuk. Biol. 70:756-766 (2001).
Groot et al., "Kazrin, a novel periplakin-interacting protein associated with desmosomes and the keratinocyte plasma membrane," J. Cell Biol. 166:653-659 (2004).
Hansen-Pupp et al., "Inflammation at birth and the insulin-like growth factor system in very preterm infants," Acta Paediatrica 96:830-836 (2007).

(Continued)

*Primary Examiner* — Jacob Cheu
(74) *Attorney, Agent, or Firm* — Fish & Richardson P.C.

(57) ABSTRACT

Provided are methods for predicting the risk of pre-term birth in a pregnant subject, for identifying a subject having an increased risk of pre-term birth, for selecting a subject for participation in a clinical study, and for decreasing the risk of pre-term birth in a subject. These methods include providing a sample from the subject and detecting the level of one or more of growth arrest-specific protein 1 (GASI), ALL1-fused gene from chromosome 4 protein (AR4)/Fragile X Mental Retardation 2 (FMR2) family member 3 (AFF3), transthyretin (TTR), ryanodine receptor 1 (RYRI), E26 transformation specific variant 6 (ETV6), claudin-10, zinc finger protein 23 (ZNF23), collagen type XXVII a1 (COL27AI), Kazrin isoform-1, keratin-associated protein 10-9 (KRTAPIO-9), Huntingtin (HTT), microtubule associated protein 9 (MAP9), coiled-coil domain-containing protein 13 (CCDC13), inositol hexakisphosphate and diphosphoinositol-pentakisphosphate kinase isoform 2 (HISPPDI), immunoglobulin gamma-3 chain C (IGHG3), cysteine- and histidine-rich protein-1 (CYHRI), and XP 002348181.

24 Claims, 3 Drawing Sheets

(56) References Cited

OTHER PUBLICATIONS

Hedlund et al., "Human placenta expresses and secretes NKG2D ligands via exosomes that down-modulate the cognate receptor expression: evidence for immunosuppressive function," J. Immunol. 183:340-351 (2009).

Honest et al., "Accuracy of cervicovaginal fetal fibronectin test in predicting risk of spontaneous preterm birth: systematic review," BMJ 325:301-311 (2002).

Huang et al., "Characterization of ZNF23, a KRAB-containing protein that is downregulated in human cancers and inhibits cell cycle progression," Exp. Cell Res. 313 :254-264 (2007).

Iams, "The epidemiology of preterm birth," Clin. Perinatol. 30:651-664 (2003).

International Preliminary Report on Patentability issued in PCT/US2012/055166 on Mar. 18, 2014 (9 pages).

International Search Report and Written Opinion issued in PCT/US2012/055166 on Feb. 20, 2013 (13 pages).

Leitich et al., "Cervicovaginal fetal fibronectin as a marker for preterm delivery: a meta-analysis," Am. J Obstet. Gynecol. 180:1169-1176 (1999).

Mercorio et al., "Cervical fetal fibronectin as a predictor of first trimester pregnancy outcome in unexplained recurrent miscarriage," Eur. J Gynecol. Reprod. Biol. 126:165-169 (2006).

Merlino et al., "Impact of weight loss between pregnancies on recurrent preterm birth," Am. J. Obstet. Gynecol. 195:818-821 (2006).

Moore et al., "A prospective study to investigate the relationship between periodontal disease and adverse pregnancy outcome," Brit. Dent. J. 197:251-258 (2004).

Moore et al., "An investigation into the association among preterm birth, cytokine gene polymorphisms and periodontal disease," Brit. J. Obstet. Gynecol. 111: 125-132 (2004).

Nance et al., "Analysis of a very large trinucleotide repeat in a patient with juvenile Huntington's disease," Neurology 52:392-394 (1999).

Patent Examination Report issued in AU2013201774 on Apr. 4, 2014 (5 pages).

Roman et al., "Transcriptional regulation of the human interleukin 1beta gene by fibronectin: role of protein kinase C and activator protein 1 (AP-1)," Cytokine 12:1581-1596 (2000).

Sibai et al., "Plasma CRH measurement at 16 to 20 weeks' gestation does not predict preterm delivery in women at high-risk for preterm delivery," Am. J. Obstet. Gynecol. 193:1181-1186 (2005).

Slattery et al., "Preterm Delivery," Lancet 360:1489-1497 (2002).

Spong, "Prediction and prevention of recurrent spontaneous preterm birth," Obstet. Gynecol. 110:405-415 (2007).

Szekeres-Bartho et al., "Increased NK activity is responsible for higher cytotoxicity to HEF cells by lymphocytes of women with threatened preterm delivery," Am. J Reprod. Immunol. 7:22-26 (1985).

Szekeres-Bartho et al., "Lymphocyte cytotoxicity assay for predicting preterm delivery of small for date babies," Am. J Reprod. Immunol. 2:102-103 (1982).

Tucker et al., "Epidemiology of preterm birth," Brit. Med. J. 329:675-678 (2004).

Verhaeghe et al., "Regulation of insulin-like growth factor-I and insulin-like growth factor binding protein-1 concentrations in preterm fetuses," Am. J Obstet. Gynecol. 188:485-491 (2003).

Vogel et al., "Biomarkers for the prediction of preterm delivery," Acta Obstet. Gynecol. Scand. 84:516-525 (2005).

Wen et al., "Epidemiology of preterm birth and neonatal outcome," Semin. Neonatal Med. 9:429-435 (2004).

Whitecar et al., "Altered expression of TCR-CD3zeta induced by sera from women with preeclampsia," Am. J. Obstet. Gynecol. 185:812-881(2001).

Hinks et al., "Association of the AFF3 gene and IL2/IL21 gene region with juvenile idiopathic arthritis," Genes and Immunity, 11(2):194-198 (Mar. 2010).

Stebel et al., "The growth suppressing gas1 product is a GPI-linked protein," FEBS Letters, 481(2):152-158 (Sep. 2000).

Supplementary Partial European Search Report issued in EP12830958 on Dec. 22, 2014.

International Search Report and Written Opinion of International Patent Application No. PCT/US2012/055166, mailed Feb. 20, 2013, 12 pages.

\* cited by examiner

METHODS OF PREDICTING AND DECREASING THE RISK OF PRE-TERM BIRTH

CROSS-REFERENCE TO RELATED APPLICATIONS

This application is a U.S. National Phase Application of International Patent Application No. PCT/US2012/055166 filed Sep. 13, 2012, which claims priority to U.S. Provisional Patent Application Ser. No. 61/535,778, filed on Sep. 16, 2011, the contents of both of which are incorporated herein by reference in their entirety.

STATEMENT

The sequence listing contained in File "17929-0009US1SequenceListing.TXT", created on Mar. 10, 2014, 649 KB (665,453 bytes), is hereby incorporated.

TECHNICAL FIELD

This invention relates to biomarkers of pre-term birth, and methods of use thereof.

BACKGROUND

Pre-term births account for 12.7% of live births in the U.S. (Goldenberg et al., Lancet 371:75-84, 2008). The sequelae of pre-term birth include immediate complications, specifically mortality and significant morbidity. More than 60% of neonatal mortality results from births occurring prior to 30 weeks gestation. In 2001, pre-term birth surpassed birth defects as the leading cause of neonatal mortality (Wen et al., Semin. Neonatal Med. 9:429-435, 2004). Pre-term birth accounts for one in five children with mental retardation, one in three children with vision impairment, and approximately 50% of children with cerebral palsy (Slattery et al., Lancet 360:1489-1497, 2002). As adults, children born pre-term have an increased risk for cardiovascular disease, an increased risk for diabetes, and have a possible increase in cancer risk (Spong, Obstet. Gynecol. 110:405-415, 2007). For the mother, delivering pre-term increases her risk of a subsequent pre-term delivery.

SUMMARY

The present invention is based, at least in part, on the discovery and characterization of differences in the presence or level of different proteins in samples (e.g., the presence or level of different proteins associated with or within exosomes within the samples) from pregnant women who later have term delivery or pregnant women who later have pre-term delivery. Thus, the present invention includes methods for diagnosing and predicting the risk of pre-term birth based on the level, e.g., presence (e.g., a level above a threshold, e.g., detectable, level) or absence (e.g., a level below a threshold level or an undetectable level) of one or more of growth arrest-specific protein 1 (GAS1), ALL1-fused gene from chromosome 4 protein (AR4)/Fragile X Mental Retardation 2 (FMR2) family member 3 (AFF3), transthyretin (TTR), ryanodine 1 receptor 1 (RYR1), E26 transformation specific variant 6 (ETV6), claudin-10, zinc finger protein 23 (ZNF23), collagen type XXVII α1 (COL27A1), Kazrin isoform-1, keratin-associated protein 10-9 (KRTAP10-9), microtubule-associated protein 9 (MAP9), coiled-coil domain-containing protein 13 (CCDC13), inositol hexakisphosphate and diphosphoinositol-pentakisphosphate kinase isoform-2 (HISPPD1), Huntingtin (HTT), immunoglobulin gamma-3 chain C (IGHG3), cysteine and histidine-rich protein-1 (CYHR1), and XP_002348181 in the sample (e.g., presence or absence in exosomes present in the sample).

Provided herein are methods for predicting the risk of pre-term birth, or identifying a pregnant subject having an increased risk of pre-term birth, wherein the methods include providing a sample (e.g., a sample containing a biological fluid, e.g., serum or plasma) from the pregnant subject, and detecting the level, e.g., the presence (e.g., a level above a threshold, e.g., detectable, level) or absence (e.g., a level below a threshold level or an undetectable level) of one or more (e.g., one, two, three, four, five, six, seven, eight, nine, ten, eleven, twelve, thirteen, fourteen, fifteen, sixteen, or seventeen) of GAS1, AFF3, TTR, RYR1, ETV6, claudin-10, ZNF23, COL27A1, Kazrin isoform-1, KRTAP10-9, HTT, MAP9, CCDC13, HISPPD1, IGHG3, CYHR1, and XP_002348181 in the sample, wherein the presence of one or more (e.g., one, two, three, four, five, six, seven, eight, nine, ten, eleven, or twelve) of GAS1, AFF3, TTR, RYR1, ZNF23, COL27A1, Kazrin isoform-1, KRTAP-10, HTT, IGHG3, CYHR1, and XP_002348181 and/or the absence of one or more (e.g., one, two, three, four, or five) of ETV6, claudin-10, MAP9, CCDC13, and HISPPD1 in the sample indicates that the pregnant subject has an increased (e.g., a statistically significant increase, such as at least 5%, 10%, 15%, 20%, 25%, 30%, 35%, 40%, 45%, 50%, 55%, 60%, 65%, 70%, 75%, 80%, 85%, 90%, 95%, or 100%) risk of pre-term delivery, or identifies the pregnant subject as having an increased risk of pre-term delivery. Some embodiments of these methods further include detecting the level, e.g., presence (e.g., a level above a threshold, e.g., detectable, level) or absence (e.g., a level below a threshold level or an undetectable level), of fibronectin in the sample, wherein the presence of fibronectin in the sample further indicates that the pregnant subject has an increased risk (e.g., a statistically significant increase) of pre-term delivery, or identifies the pregnant subject as having an increased risk of pre-term delivery.

Also provided are methods of selecting a subject for participation in a clinical study, wherein the methods include providing a sample (e.g., a sample containing a biological fluid, e.g., serum or plasma) from the subject, detecting the level, e.g., the presence (e.g., a level above a threshold, e.g., detectable, level) or absence (e.g., a level below a threshold level or an undetectable level) of one or more (e.g., one, two, three, four, five, six, seven, eight, nine, ten, eleven, twelve, thirteen, fourteen, fifteen, sixteen, or seventeen) of GAS1, AFF3, TTR, RYR1, ETV6, claudin-10, ZNF23, COL27A1, Kazrin isoform-1, KRTAP10-9, HTT, MAP9, CCDC13, HISPPD1, IGHG3, CYHR1, and XP_002348181 in the sample, and selecting a subject having one or more (e.g., one, two, three, four, five, six, seven, eight, nine, ten, eleven, or twelve) of GAS1, AFF3, TTR, RYR1, ZNF23, COL27A1, Kazrin isoform-1, KRTAP10-9, HTT, IGHG3, CYHR1, and XP_002348181 present in the sample (e.g., present in the sample above a threshold), and/or not having one or more (e.g., one, two, three, four, or five) of ETV6, claudin-10, MAP9, CCDC13, and HISPPD1 in the sample (e.g., not detectable or present below a threshold level) for participation in a clinical study. Some embodiments of these methods further include detecting the level, e.g., the presence (e.g., a level above a threshold, e.g., detectable, level) or absence (e.g., a level below a threshold level or an undetectable level) of fibronectin in the sample, and selecting a subject having fibronectin present (e.g., above a threshold level) in the sample, and having one or more (e.g., one, two, three, four, five, six, seven, eight, nine, ten, eleven, or twelve) of GAS1, AFF3, TTR, RYR1, ZNF23, COL27A1, Kazrin isoform-1, KRTAP10-9, HTT, IGHG3, CYHR1, and XP_002348181 present (e.g., above a threshold, e.g., detectable, level) in the sample, or not having one or more (e.g., one, two, three, four, or five) of ETV6, claudin-10, MAP9, CCDC13, and HISPPD1 in the sample (e.g., below a threshold, e.g., detectable, level), for participation in a clinical study. In some embodiments, the subject is pregnant.

Also provided are methods of decreasing the risk of pre-term birth, wherein the method includes providing a sample (e.g., a sample containing a biological fluid, e.g., serum or plasma) from the pregnant subject, detecting the level, e.g., the presence (e.g., a level above a threshold, e.g., detectable, level) or absence (e.g., a level below a threshold level or an undetectable level) of one or more (e.g., one, two, three, four, five, six, seven, eight, nine, ten, eleven, twelve, thirteen, fourteen, fifteen, sixteen, or seventeen) of GAS1, AFF3, TTR, RYR1, ETV6, claudin-10, ZNF23, COL27A1, Kazrin isoform-1, KRTAP10-9, HTT, MAP9, CCDC13, HISPPD1, IGHG3, CYHR1, and XP_002348181 in the sample, and administering a therapeutic treatment (or selecting a therapeutic treatment for administering) to a pregnant subject having one or more (e.g., one, two, three, four, five, six, seven, eight, nine, ten, eleven, or twelve) of GAS1, AFF3, TTR, RYR1, ZNF23, COL27A1, Kazrin isoform-1, KRTAP10-9, HTT, IGHG3, CYHR1, and XP_002348181 present in the sample (e.g., above a threshold, e.g., detectable, level), and/or not having one or more (e.g., one, two, three, four, or five) of ETV6, claudin-10, MAP9, CCDC13, and HISPPD1 in the sample (e.g., below a threshold, e.g., detectable, level). Some embodiments of these methods further include detecting the level, e.g., the presence (e.g., a level above a threshold, e.g., detectable, level) or absence (e.g., a level below a threshold level or an undetectable level) of fibronectin in the sample, and administering a therapeutic treatment (or selecting a therapeutic treatment for administering) to a pregnant subject having fibronectin present in the sample (e.g., above a threshold, e.g., detectable, level), and having one or more (e.g., one, two, three, four, five, six, seven, eight, nine, ten, eleven, or twelve) of GAS, AFF3, TTR, RYR1, ZNF23, COL27A1, Kazrin isoform-1, KRTAP10-9, HTT, IGHG3, CYHR1, and XP_002348181 present in the sample (e.g., above a threshold, e.g., detectable, level), or not having one or more (e.g., one, two, three, four, or five) of ETV6, claudin-10, MAP9, CCDC13, and HISPPD1 in the sample (e.g., below a threshold, e.g., detectable, level). In some embodiments of these methods, the therapeutic treatment is selected from: complement inhibitors, hormone treatment, steroid treatment, passive immunotherapy with intravenous immunoglobulins, aspirin, and tumor necrosis factor (TNF-α) antagonists.

In some embodiments, the methods described herein include detecting GAS1, AFF3, fibronectin, TTR, RYR1, ETV6, claudin-10, ZNF23, COL27A1, Kazrin isoform-1, KRTAP10-9, HTT, MAP9, CCDC13, HISPPD1, IGHG3, CYHR1, and/or XP_002348181 protein or mRNA. Some embodiments of all of the methods described herein include providing a sample (e.g., a sample containing a biological fluid, e.g., serum or plasma) from the subject (e.g., a pregnant subject), and enriching exosomes from the sample, wherein the level, e.g., the presence (e.g., a level above a threshold, e.g., detectable, level) or absence (e.g., a level below a threshold level or an undetectable level) of one or more (e.g., one, two, three, four, five, six, seven, eight, nine, ten, eleven, twelve, thirteen, fourteen, fifteen, sixteen, seventeen, or eighteen) of GAS1, AFF3, fibronectin, TTR, RYR1, ETV6, claudin-10, ZNF23, COL27A1, Kazrin isoform-1, KRTAP10-9, HTT, MAP9, CCDC13, HISPPD1, IGHG3, CYHR1, and XP_002348181 in the enriched exosomes is determined. In some embodiments of all of the above methods, the enriching is performed by one or more (e.g., one, two, three, or four) of size exclusion chromatography, ultracentrifugation, precipitation, and through the use of magnetic beads.

In any of the methods described herein, the subject (e.g., a pregnant subject) has had at least one (e.g., one, two, three, four, five, or more) pre-term birth. In some embodiments, the subject is primigravid (e.g., pregnant women with no previous deliveries). In some embodiments of the methods described herein, the sample is obtained from the subject within the first 20 weeks, within the first 13 weeks, within the first 12 weeks, or within the first 8 weeks of gestation. In some embodiments of all of the methods described herein, the sample is obtained from the subject at 15 to 18 weeks of gestation. In some embodiments of all of the methods described herein, the subject is human. In some embodiments of all of the methods described herein, the sample contains serum, plasma, amniotic fluid, vaginal secretion, urine, or saliva Also provided are kits that contain one or more (e.g., two or more, or two, three, four, five, six, seven, eight, nine, ten, eleven, twelve, thirteen, fourteen, fifteen, sixteen, seventeen, or eighteen) antibodies that bind to GAS1, AFF3, fibronectin, TTR, RYR1, ETV6, claudin-10, ZNF23, COL27A1, Kazrin isoform-1, KRTAP10-9, HTT, MAP9, CCDC13, HISPPD1, IGHG3, CYHR1, and XP_002348181. In some embodiments of the kits described herein, the kit is an enzyme-linked immunosorbent assay. Any of the kits described herein can be used to perform any of the methods described herein. In some embodiments, the kits can further include instructions for performing any of the methods described herein.

Also provided are kits that contain one or more (e.g., two or more, or 2, 3, 4, 5, 6, 7, 8, 9, 10, 11, 12, 13, 14, 15, 16, 17, 18, 19, 20, 21, 22, 23, 24, 25, 26, 27, 28, 29, or 30) nucleic acid primers that are complementary to a contiguous sequence within a mRNA encoding a GAS1, AFF3, fibronectin, TTR, RYR1, ETV6, claudin-10, ZNF23, COL27A1, Kazrin isoform-1, KRTAP10-9, HTT, MAP9, CCDC13, HISPPD1, IGHG3, CYHR1, and XP_002348181.

As used herein, by the term "increase" is meant an increase, such as by at least 5%, 10%, 15%, 20%, 25%, 30%, 35%, 40%, 45%, 50%, 55%, 60%, 65%, 70%, 75%, 80%, 85%, 90%, 95%, or 100%. In some embodiments, the increase is statistically significant. An increase, as described herein, can be determined by comparison to a threshold value (e.g., a threshold detection level of an assay for determining the presence or absence of a protein or mRNA, or a level of expression (protein or mRNA) in a control subject (e.g., a positive control subject who is preferably of the same or similar age and/or gestational stage, that is pregnant and the pregnancy results in a term birth, optionally a subject that has not had a pre-term birth (e.g., a subject that has not had a pre-term birth and/or has had at least one term birth)). As used herein, the term "increase" can also apply to an elevated risk of pre-term birth compared to a control population (e.g., a population of subjects of substantially the same age and/or gestational stage that are pregnant and the pregnancy results in a term birth, optionally a population of subjects that that have not had a pre-term birth (e.g., a population of subjects that have not had a pre-term birth and/or have had at least one term birth)).

By the term "pre-term birth" is meant a birth that occurs before 37 weeks of gestation, e.g., between 23 to 37 weeks of gestation (e.g., 23 weeks to 34 weeks, 23 weeks to 30 weeks, 23 weeks to 36 weeks, or 26 weeks to 37 weeks of gestation).

By the term "at risk of pre-term birth" is meant a subject that has an increased risk of having a pre-term birth as compared to a control population (e.g., a group of subjects of substantially the same age and/or gestational stage, optionally a group of subjects that have never had a pre-term birth (e.g., a group of subjects that have never had a pre-term birth and/or have had at least one term birth), or a group of subjects that are pregnant and the pregnancy results in a term birth).

As used herein, by the term "decrease" is meant a decrease, such as by at least 5%, 10%, 15%, 20%, 25%, 30%, 35%, 40%, 45%, 55%, 60%, 65%, 70%, 75%, 80%, 85%, 90%, or 95%. In some embodiments the decrease is statistically significant. A decrease, as described herein, can be determined by comparison to a threshold value (e.g., a threshold detection level of an assay for determining the presence or absence of a protein or mRNA, or a level of expression (protein or mRNA) in a control subject (e.g., a subject of the same age or a subject that has not had a pre-term birth (e.g., a subject that has not had a pre-term birth and has had at least one term birth), or the same subject prior to the start of her pregnancy). A decrease can also refer to a decrease in the risk of pre-term birth in a pregnant subject that occurs upon administering a therapeutic treatment to a pregnant subject (as described herein).

As used herein, by the term "presence" is meant a level that is greater than a threshold level (e.g., a threshold detection level of an assay for determining the presence or absence of a protein or mRNA, or a level of expression (protein or mRNA) in a control subject (e.g., a subject of the same age, a subject that has not had a pre-term birth (e.g., a subject that has not had a pre-term birth and has had at least one term birth), a subject who is pregnant and the pregnancy results in a term birth, or the same subject prior to the start of her pregnancy). Additional threshold levels can be determined using methods described herein and known in the art.

As used herein, by the term "absence" is meant a level that is less than a threshold level (e.g., a threshold detection level of an assay for determining the presence or absence of a protein or mRNA, or a level of expression (protein or mRNA) in a control subject (e.g., a subject of substantially the same age and/or gestational stage that is pregnant and the pregnancy results in a term birth, optionally a subject that has not had a pre-term birth (e.g., a subject that has not had a pre-term birth and/or has had at least one term birth)).

As used herein, a "subject" is a female member of the class mammalia, including humans, domestic and farm animals, and zoo, sports or pet animals, such as mouse, rabbit, pig, sheep, goat, cattle, horse (e.g., race horse), and higher primates. In preferred embodiments, the subject is a human female.

The term "detecting" is meant measuring or identifying the presence of any portion of a molecule (e.g., peptide and mRNA) in a sample (e.g., an exosome-enriched sample). Detecting, as described herein, can include identifying or measuring the presence or absence of one or more (e.g., one, two, three, four, five, six, seven, eight, nine, ten, eleven, twelve, thirteen, fourteen, or fifteen) protein(s) having at least 10 (e.g., at least 11, 12, 13, 14, 15, 16, 17, 18, 19, 20, or 25) contiguous amino acids of GAS1, AFF3, fibronectin, TTR, RYR1, ETV6, claudin-10, ZNF23, COL27A1, Kazrin isoform-1, KRTAP10-9, HTT, MAP9, CCDC13, HISPPD1, IGHG3, CYHR1, or XP_002348181 in a sample. Exemplary proteins that can be detected contain at least 10 (e.g., at least 11, 12, 13, 14, 15, 16, 17, 18, 19, 20, or 25) contiguous amino acids of a sequence within any one of SEQ ID NOS: 2, 4, 6, 8, 10, 12, 14, 16, 18, 20, 22, 24, 26, 28, 30, 32, 34, 36, 38, 40, 42, 45, 46, 49, 50, 53, 54, 56, 59, 60, 63, 64, 66, 68, 72-74, or 78-80. The contiguous amino acid sequence can be present within any portion of the sequence of SEQ ID NOS: 2, 4, 6, 8, 10, 12, 14, 16, 18, 20, 22, 24, 26, 28, 30, 32, 34, 36, 38, 40, 42, 45, 46, 49, 50, 53, 54, 56, 59, 60, 63, 64, 66, 68, 72-74, or 78-80 for example, a sequence starting at the N-terminus, a sequence ending at the C-terminus, or a sequence starting at any single amino acid within the sequence (with the exception of the last four amino acids at the C-terminus of the protein). Exemplary proteins that can be detected are SEQ ID NO: 2, 4, 6, 8, 10, 12, 14, 16, 18, 20, 22, 24, 26, 28, 30, 32, 34, 36, 38, 40, 42, 45, 46, 49, 50, 53, 54, 56, 59, 60, 63, 64, 66, 68, 72-74, or 78-80.

Exemplary mRNA that can be detected contain at least 5 (e.g., at least 6, 7, 8, 9, 10, 11, 12, 13, 14, 15, 16, 17, 18, 19, or 20) contiguous nucleotides of the sequence within any one of SEQ ID NOS: 1, 3, 5, 7, 9, 11, 13, 15, 17, 19, 21, 23, 25, 27, 29, 31, 33, 35, 37, 39, 41, 43, 44, 47, 48, 51, 52, 55, 57, 58, 61, 62, 65, 67, 69-71, or 75-77. The contiguous nucleotide sequence can be present within any portion of the sequence of SEQ ID NOS: 1, 3, 5, 7, 9, 11, 13, 15, 17, 19, 21, 23, 25, 27, 29, 31, 33, 35, 37, 39, 41, 43, 44, 47, 48, 51, 52, 55, 57, 58, 61, 62, 65, 67, 69-71, or 75-77, for example, a sequence starting at the 5'-terminus, a sequence ending at the 3'-terminus, or a sequence starting at any single nucleotide within the sequence (with the exception of the last four nucleotides at the 3'-terminus of the mRNA). Additional exemplary mRNAs that can be detected contain the sequence of SEQ ID NO: 1, 3, 5, 7, 9, 11, 13, 15, 17, 19, 21, 23, 25, 27, 29, 31, 33, 35, 37, 39, 41, 43, 44, 47, 48, 51, 52, 55, 57, 58, 61, 62, 65, 67, 69-71, or 75-77.

By the phrase "therapeutic treatment" is meant a treatment that can decrease (as defined herein) the risk of having a pre-term birth in a pregnant subject. Non-limiting examples of therapeutic treatment are known in the art and include, without limitation, complement inhibitors, hormone treatment, steroid treatment, passive immunotherapy with intravenous immunoglobulins, aspirin, and TNF-α antagonists. Examples of therapeutic treatments are described herein and additional examples of therapeutic treatments are known in the art.

By the term "exosome" is meant a lipid-based microparticle or nanoparticle present in a sample (e.g., a biological fluid) obtained from a subject. The term exosome is also referred to in the art as a microvesicle or nanovesicle. In some embodiments, an exosome is between about 20 nm to about 90 nm in diameter. Exosomes are secreted or shed from a variety of different mammalian cell types. Non-limiting examples of exosomes and methods for the enrichment of exosomes from a sample (e.g., a biological fluid) obtained from a mammalian subject are described herein. Additional examples of exosomes and methods for the enrichment of exosomes from a sample obtained from a mammalian subject are known in the art.

By the term "sample" or "biological sample" is meant any biological fluid obtained from a mammalian subject (e.g., composition containing blood, plasma, urine, saliva, breast milk, tears, vaginal discharge, or amniotic fluid).

Unless otherwise defined, all technical and scientific terms used herein have the same meaning as commonly understood by one of ordinary skill in the art to which this invention belongs. Methods and materials are described herein for use in the present invention; other, suitable methods and materials known in the art can also be used. The materials, methods, and examples are illustrative only and not intended to be limiting. All publications, patent applications, patents, sequences, database entries, and other references mentioned herein are incorporated by reference in their entirety. In case of conflict, the present specification, including definitions, will control.

Other features and advantages of the invention will be apparent from the following detailed description and figures, and from the claims.

DETAILED DESCRIPTION

Figure 1:
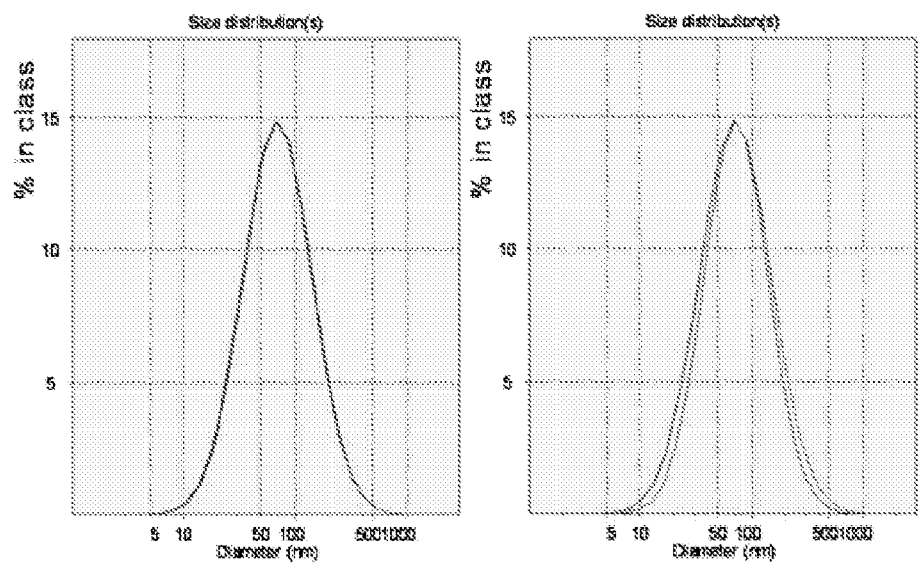
FIG. 1 is a pair of graphs showing the size distribution of exosomes isolated from term delivering women (left graph) and pre-term delivering women (right graph) as measured by dynamic light scattering. The data shown are from three independent measurements.

Pre-term birth is a multi-factorial disease caused by genetic, social, and environmental factors. There are significant disparities in the rates and consequences of pre-term birth across racial and ethnic groups that are unexplained (Tucker et al., Brit. Med. J. 329:675-678, 2004). Non-Hispanic African American women have 1.5-fold greater pre-term birth rates than Hispanic and non-Hispanic Caucasian women. For pre-term births that were <32 weeks gestation, this disparity was even greater. African Americans have nearly a 4-fold higher rate of infant mortality due to pre-term births than Caucasians. Studies have demonstrated two types of spontaneous pre-term birth, based on pregnancy duration at delivery and likelihood of subsequent pre-term births (Tucker et al., Brit. Med. J. 329:675-678, 2004; Goldenberg et al., Am. J. Public Health 88:233-238, 1998). Pre-term births prior to 32 weeks occur more commonly in African, non-Caribbean Hispanic and Caucasian women (Goldenberg et al., Am. J. Public Health 88:233-238, 1998). This demographic distribution remains even after compensating for other risk factors, including infections. These early pre-term births are commonly linked to long-term infant morbidity and to greater risk of recurrent births in subsequent pregnancies (Tucker et al., Brit. Med. J. 329:675-678, 2004). Pre-term births between 32 and 37 weeks are commonly associated with increased uterine contraction frequency; however increased uterine volume caused by polyhydramnios or multi-fetal gestations are not linked with an elevated risk of pre-term birth (Iams, Clin. Perinatol. 30:651-664, 2003).

Age, parity, BMI, ethnicity, socioeconomic status, smoking, anxiety, and depression are associated with pre-term birth (Goldenberg et al., Lancet 371:75-84, 2008; Goldenberg et al., Am. J. Public Health 88:233-238, 1998). Although initially thought to be promising, composite risk scores incorporating history, socioeconomic status, and lifestyle, have not improved outcome because of low sensitivity and the lack of efficacy of the interventions. Based on the pathophysiologic heterogeneity of spontaneous pre-term birth, the ability of any single marker to predict pre-term birth is unlikely. Currently, several circulating markers are used to predict pre-term birth, including interleukin-6, C-reactive protein, and corticotrophin-releasing hormone (CRH) (Vogel et al., Acta Obstet. Gynecol. Scand. 84:516-525, 2005; Mercer et al., Am. J. Obstet. Gynecol. 195:818-821, 2006; Goldenberg et al., Am. J. Obstet. Gynecol. 185:643-651, 2001; Sibai et al., Am. J. Obstet. Gynecol. 193:1181-1186, 2005).

Provided herein are methods for predicting the risk of pre-term birth, for identifying a pregnant subject having an increased risk of pre-term birth, for selecting a subject (e.g., a pregnant subject) for participation in a clinical study, for decreasing the risk of pre-term birth in a pregnant subject, and for selecting a pregnant subject for a treatment to decrease the risk of pre-term birth. These methods include detecting the level, e.g., the presence (e.g., a level above a threshold, e.g., detectable, level) or absence (e.g., a level below a threshold level or an undetectable level) of one or more of: GAS1, AFF3, fibronectin, TTR, RYR1, ETV6, claudin-10, ZNF23, COL27A1, Kazrin isoform-1, KRTAP10-9, HTT, MAP9, CCDC13, HISPPD1, IGHG3, CYHR1, and XP_002348181 in a sample from the subject. Various aspects of these methods are described herein. Any one or more of these various aspects can be combined without limitation.

Growth Arrest-Specific Protein 1 (GAS1)

Growth Arrest-Specific Protein 1 (GAS1) plays a role in growth suppression. GAS1 blocks entry to S-phase and prevents cycling of normal and transformed cells. GAS1 is a putative tumor suppressor gene. The sequence of human GAS1 can be found at NM_002048.2 (nucleic acid; SEQ ID NO: 1) and NP_002039.2 (protein; SEQ ID NO: 2).

Some embodiments of all of the methods described herein involve the detection or determination of the level, e.g., the presence (e.g., a level above a threshold, e.g., detectable, level) or absence (e.g., a level below a threshold level or an undetectable level) of GAS1 protein (or fragment thereof) or mRNA, in a sample from the subject (e.g., in the serum of the subject). In these methods, the GAS1 protein that is detected can be, for example, a protein containing the sequence of SEQ ID NO: 2, or any fragment thereof (as described herein). In additional examples of these methods, the GAS1 mRNA that is detected can be, for example, a mRNA containing the sequence of SEQ ID NO: 1 (as described herein). In some embodiments of the invention, the GAS1 protein (or fragment thereof) or mRNA, is present or detectable in an exosome (e.g., an exosome that is enriched from the sample).

AF4/FMR2 Family Member 3 (AFF3)

Acute Lymphocytic Leukemia-1 (ALL1)-fused gene from chromosome 4 protein (AR4)/Fraxile X Mental Retardation 2 (FMR2) family member 3 (AFF3) is a gene that encodes a tissue-restricted nuclear transcriptional activator that is preferentially expressed in lymphoid tissue. Isolation of this protein initially defined a highly conserved lymphoid nuclear protein 4 (LAF4)/myeloid/lymphoid leukemia translocated to 2 (MLLT2) gene family of nuclear transcription factors that may function in lymphoid development and oncogenesis. In some acute lymphoblastic leukemia (ALL) patients, this gene has been found fused to the gene for myeloid/lymphoid leukemia (MLL). Multiple alternatively spliced transcript variants that encode different proteins have been found for this gene.

Five variants of human AFF3 can be found at: NM_002285.2 (nucleic acid; SEQ ID NO: 3) and NP_002276.2 (protein; SEQ ID NO: 4); NM_001025108.1 (nucleic acid; SEQ ID NO: 5) and NP_001020279.1 (protein; SEQ ID NO: 6); BC036895.1 (nucleic acid; SEQ ID NO: 7) and AAH36895.1 (protein; SEQ ID NO: 8); BC136579.1 (nucleic acid; SEQ ID NO: 9) and AAI36580.1 (protein; SEQ ID NO: 10); and BC144266.1 (nucleic acid; SEQ ID NO: 11) and AAI44267.1 (protein; SEQ ID NO: 12).

Some embodiments of all of the methods described herein involve the detection or determination of the level, e.g., the presence (e.g., a level above a threshold, e.g., detectable, level) or absence (e.g., a level below a threshold level or an undetectable level) of AFF3 protein (or fragment thereof) or mRNA in a sample from the subject (e.g., in the serum of the subject). In these methods, the AFF3 protein that is detected can be, for example, a protein containing the sequence of SEQ ID NO: 4, 6, 8, 10, or 12, or any fragment thereof (as described herein). In additional examples of these methods, the AFF3 mRNA that is detected can be, for example, a mRNA containing the sequence of SEQ ID NO: 3, 5, 7, 9, or 11 (as described herein). In some embodiments of the invention, the AFF3 protein (or fragment thereof) or mRNA is present or detectable in an exosome (e.g., an exosome enriched from a sample).

Fibronectin

Fibronectin is a high molecular weight (~440 kD) extracellular matrix glycoprotein that binds to membrane-spanning receptor proteins called integrins. In addition to integrins, fibronectin also binds extracellular matrix components, such as collagen, fibrin, and heparin sulfate proteoglycans (e.g., syndecans).

Fibronectin exists as a dimer, consisting of two nearly identical monomers linked by a pair of disulfide bonds. The fibronectin protein is produced from a single gene, but alternative splicing of its pre-mRNA leads to the creation of several isoforms.

Two types of fibronectin are present in vertebrates: a soluble plasma fibronectin (formerly called "cold-soluble globulin" or CIg) and insoluble cellular fibronectin. Soluble plasma fibronectin is a major protein component of blood plasma (300 µg/mL) and is produced in the liver by hepatocytes. Insoluble cellular fibronectin is secreted by various cells, primarily fibroblasts, as a soluble dimer and is then assembled into an insoluble matrix in a complex cell-mediated process.

Fibronectin plays a major role in cell adhesion, growth, migration, and differentiation, and it is important for processes, such as wound healing and embryonic development. Altered fibronectin expression, degradation, and organization have been associated with a number of pathologies, including cancer and fibrosis.

The maternal extracellular matrix and maternal-fetal interface have been suggested to play a pivotal role in conditions of early recurrent abortions, intrauterine growth restriction, and pre-eclampsia. Fetal fibronectin is one extracellular matrix protein that may act as "trophoblast glue," with increased concentrations at the chorionic-decidual margin and surrounding the extracillous trophoblasts (Mercorio et al., *Eur. J. Gynecol. Reprod. Biol.* 126:165-169, 2006; Guller et al., *Up-To-Date*, version 17.3, 2009). Integrin receptors for fibronectin with strong binding activity have been observed on the surface of blastocysts (Mercorio et al., *Eur. J. Gynecol. Reprod. Biol.* 126:165-169, 2006). Derangement in the signals and receptivity between cellular matrix proteins, e.g., fibronectin, and cell adhesion molecules may be responsible for pregnancy failure.

The human fibronectin gene has three regions subject to alternative splicing, with the potential to produce 20 different transcript variants. The human sequences are as follows: NM_212482.1 (nucleic acid; SEQ ID NO: 13) and NP_997647.1 (protein; SEQ ID NO: 14) for fibronectin 1 isoform 1 preprotein; NM_212475.1 (nucleic acid; SEQ ID NO: 15) and NP_997640.1 (protein; SEQ ID NO: 16) for fibronectin 1 isoform 2 preprotein; NM_002026.2 (nucleic acid; SEQ ID NO: 17) and NP_002017.1 (protein; SEQ ID NO: 18) for fibronectin 1 isoform 3 preprotein; NM_212478.1 (nucleic acid; SEQ ID NO: 19) and NP_997643.1 (protein; SEQ ID NO: 20) for fibronectin 1 isoform 4 preprotein; NM_212476.1 (nucleic acid; SEQ ID NO: 21) and NP_997641.1 (protein; SEQ ID NO: 22) for fibronectin 1 isoform 5 preprotein; NM_212474.1 (nucleic acid; SEQ ID NO: 23) and NP_997639.1 (protein; SEQ ID NO: 24) for fibronectin 1 isoform 6 preprotein; and NM_054034.2 (nucleic acid; SEQ ID NO: 25) and NP_473375.2 (protein; SEQ ID NO: 26) for fibronectin 1 isoform 7 preprotein.

Some embodiments of all of the methods described herein involve the detection or determination of the level, e.g., the presence (e.g., a level above a threshold, e.g., detectable, level) or absence (e.g., a level below a threshold level or an undetectable level) of fibronectin protein (or fragment thereof) or mRNA in a sample from the subject (e.g., in the serum of the subject). In these methods, the fibronectin protein that is detected can be, for example, a protein containing the sequence of SEQ ID NO: 14, 16, 18, 20, 22, 24, or 26, or a fragment thereof (as described herein). In additional examples of these methods, the fibronectin mRNA that is detected can be, for example, a mRNA containing the sequence of SEQ ID NO: 13, 15, 17, 19, 21, 23, or 25 (as described herein). In some embodiments of the invention, the fibronectin protein (or fragment thereof) or mRNA is present or detectable in an exosome (e.g., an exosome that is enriched from the sample).

Transthyretin (TTR)

Transthyretin (TTR) is a serum and cerebrospinal fluid carrier of the thyroid hormone thyroxine (T4) and retinol. TTR was originally called prealbumin because it ran faster than albumins on electrophoresis gels. TTR is known to be associated with amyloid diseases senile systemic amyloidosis (SSA), familial amyotrophic amyloid polyneuropathy (FAP), and familial amyloid cardiopathy (FAC). The sequence of human TTR can be found at NM_000371.3 (nucleic acid; SEQ ID NO: 27) and NP_000362.1 (protein; SEQ ID NO: 28).

Some embodiments of all of the methods described herein involve the detection or determination of the level, e.g., the presence (e.g., a level above a threshold, e.g., detectable, level) or absence (e.g., a level below a threshold level or an undetectable level) of TTR protein (or fragment thereof) or mRNA in a sample from the subject (e.g., in the serum of the subject). In these methods, the TTR protein that is detected can be, for example, a protein containing the sequence of SEQ ID NO: 28, or any fragment thereof (as described herein). In additional examples of these methods, the TTR mRNA that is detected can be, for example, a mRNA containing the sequence of SEQ ID NO: 27 (as described herein). In some embodiments of the invention, the TTR protein (or fragment thereof) or mRNA is present or detectable in an exosome (e.g., an exosome that is enriched from the sample).

Ryanodine Receptor 1

The ryanodine receptor 1 (RYR1) encodes a receptor found in skeletal muscle. RYR1 protein functions as a calcium release channel in the sarcoplasmic reticulum and also serves to connect the sarcoplasmic reticulum and transverse tubule. Mutations in the RYR1 gene are associated with malignant hyperthermia susceptibility, central core disease, and minimore myopathy with external ophthalmoplegia.

Alternatively spliced transcripts encoding different isoforms have been described. The human sequences are as follows: NM_000540.2 (nucleic acid; SEQ ID NO: 29) and NP_000531.2 (protein; SEQ ID NO: 30) for ryanodine receptor 1 isoform 1; and NM_001042723.1 (nucleic acid; SEQ ID NO: 31) and NP_001036188.1 (protein; SEQ ID NO: 32) for ryanodine receptor 1 isoform 2.

Some embodiments of all of the methods described herein involve the detection or determination of the level, e.g., the presence (e.g., a level above a threshold, e.g., detectable, level) or absence (e.g., a level below a threshold level or an undetectable level) of RYR1 protein (or fragment thereof) or mRNA in a sample from the subject (e.g., in the serum of the subject). In these methods, the RYR1 protein that is detected can be, for example, a protein containing the sequence of SEQ ID NO: 30 or 32, or a fragment thereof (as described herein). In additional examples of these methods, the RYR1 mRNA that is detected can be, for example, a mRNA containing the sequence of SEQ ID NO: 29 or 31 (as described herein). In some embodiments of the invention, the RYR1 protein (or fragment thereof) or mRNA is present or detectable in an exosome (e.g., an exosome that is enriched from the sample).

Zinc Finger Protein 23 (ZNF23)

Zinc finger protein 23 (ZNF23) has been characterized as a member of the Krupple-associated box-containing zinc finger protein (KRAB-ZFP) family. Several members of the KRAB-ZRP family have been shown to modulate cell growth and survival, and have been implicated for a role in malignant disorders. ZNF23 has been shown to have growth-inhibitory activity in cells (Huang et al., *Exp. Cell Res.* 313:254-264, 2007). The sequence of human ZNF23 can be found at NM_145911.1 (nucleic acid; SEQ ID NO: 41) and NP_666016.1 (protein; SEQ ID NO: 42).

Some embodiments of all of the methods described herein involve the detection or determination of the level, e.g., the presence (e.g., a level above a threshold, e.g., detectable, level) or absence (e.g., a level below a threshold level or an undetectable level) of ZNF23 protein (or a fragment thereof) or mRNA in a sample from the subject (e.g., in the serum of the subject). In these methods, the ZNF23 protein that is detected can be, for example, a protein containing the sequence of SEQ ID NO: 42, or a fragment thereof (as described herein). In additional examples of these methods, the ZNF23 mRNA that is detected can be, for example, a mRNA containing the sequence of SEQ ID NO: 41 (as described herein). In some embodiments of the invention, the ZNF23 protein or mRNA is present or detectable in an exosome (e.g., an exosome that is enriched from the sample).

Collagen Type XXVII α1 (COL27A1)

Collagen type XXVII α1 (COL27A1) is an extracellular matrix protein expressed in cartilage tissue and the eye. The sequence of human COL27A1 can be found at NM_032888.2 and AY149237 (nucleic acid; SEQ ID NO: 43 and SEQ ID NO: 44), and NP_116277.2 and AAN41263.1" (protein; SEQ ID NO: 45 and SEQ ID NO: 46).

Some embodiments of all of the methods described herein involve the detection or determination of the level, e.g., the presence (e.g., a level above a threshold, e.g., detectable, level) or absence (e.g., a level below a threshold level or an undetectable level) of COL27A1 protein (or fragment thereof) or mRNA in a sample from the subject (e.g., in the serum of the subject). In these methods, the COL27A1 protein that is detected can be, for example, a protein containing the sequence of SEQ ID NO: 45 or SEQ ID NO: 46, or a fragment thereof (as described herein). In additional examples of these methods, the COL27A1 mRNA that is detected can be, for example, a mRNA containing the sequence of SEQ ID NO: 43 or SEQ ID NO: 44 (as described herein). In some embodiments of the invention, the COL27A1 protein (or fragment thereof) or mRNA is present or detectable in an exosome (e.g., an exosome that is enriched from the sample).

Kazrin Isoform-1

Kazrin isoform-1 (also known Kazrin isoform A) is expressed in keratinocytes and may be involved in the interplay between adherens junctions and desmosomes (Groot et al., *J. Cell Biol.* 166:653-659, 2004). The sequence of human Kazrin isoform-1 can be found at NM_015209.2 and AY505119.1 (nucleic acid; SEQ ID NO: 47 and SEQ ID NO: 48), and NP_056024.1 and AAS86434 (protein; SEQ ID NO: 49 and SEQ ID NO: 50).

Some embodiments of all of the methods described herein involve the detection or determination of the level, e.g., the presence (e.g., a level above a threshold, e.g., detectable, level) or absence (e.g., a level below a threshold level or an undetectable level) of Kazrin isoform-1 protein (or fragment thereof) or mRNA in a sample from the subject (e.g., in the serum of the subject). In these methods, the Kazrin isoform-1 protein that is detected can be, for example, a protein containing the sequence of SEQ ID NO: 49 or SEQ ID NO: 50, or a fragment thereof (as described herein). In additional examples of these methods, the Kazrin isoform-1 mRNA that is detected can be, for example, a mRNA containing the sequence of SEQ ID NO: 47 or SEQ ID NO: 48 (as described herein). In some embodiments of the invention, the Kazrin isoform-1 protein (or fragment thereof) or mRNA is present or detectable in an exosome (e.g., an exosome that is enriched from the sample).

Keratin-Associated Protein 10-9 (KRTAP10-9)

Keratin-associated protein 10-9 (KRTAP10-9) is present in the interfilamentous matrix present in the hair shaft. The sequence of human KRTAP10-9 can be found at NM_198690.2 and BC131613.1 (nucleic acid; SEQ ID NO: 51 and SEQ ID NO: 52), and NP_941963.2 and AAI31614.1 (protein; SEQ ID NO: 53 and SEQ ID NO: 54).

Some embodiments of all of the methods described herein involve the detection or determination of the level, e.g., the presence (e.g., a level above a threshold, e.g., detectable, level) or absence (e.g., a level below a threshold level or an undetectable level) of KRTAP10-9 protein (or fragment thereof) or mRNA in a sample from the subject (e.g., in the serum of the subject). In these methods, the KRTAP10-9 protein that is detected can be, for example, a protein containing the sequence of SEQ ID NO: 53 or SEQ ID NO: 54, or a fragment thereof (as described herein). In additional examples of these methods, the KRTAP10-9 mRNA that is detected can be, for example, a mRNA containing the sequence of SEQ ID NO: 51 or SEQ ID NO: 52 (as described herein). In some embodiments of the invention, the KRTAP10-9 protein (or fragment thereof) or mRNA is present or detectable in an exosome (e.g., an exosome that is enriched from the sample).

Huntingtin (HTT)

The function of Huntingtin (HTT) protein is unclear; however, it has been shown to be essential for development, and the absence of Huntingtin is lethal in mice (Nasir et al., *Cell* 81:811-823, 1995). Huntingtin has also been implicated for a role in Huntingtin's disease in humans (Nance et al., *Neurology* 52:392-394, 1999). Huntingtin is highly expressed in neurons and testes in humans and rodents (Cattaneo et al., *Neuroscience* 6:919-930, 2005). The sequence of human HTT can be found at NM_002111.6 (nucleic acid; SEQ ID NO: 55) and NP_002102 (protein; SEQ ID NO: 56).

Some embodiments of all of the methods described herein involve the detection or determination of the level, e.g., the presence (e.g., a level above a threshold, e.g., detectable, level) or absence (e.g., a level below a threshold level or an undetectable level) of HTT protein (or fragment thereof) or mRNA in a sample from the subject (e.g., in the serum of the subject). In these methods, the HTT protein that is detected can be, for example, a protein containing the sequence of SEQ ID NO: 56, or a fragment thereof (as described herein). In additional examples of these methods, the HTT mRNA that is detected can be, for example, a mRNA containing the sequence of SEQ ID NO: 55 (as described herein). In some embodiments of the invention, the HTT protein (or fragment thereof) or mRNA is present or detectable in an exosome (e.g., an exosome that is enriched from the sample).

E26 Transformation-Specific Variant 6 (ETV6)

E26 transformation-specific variant 6 (ETV6) is an E26 transformation-specific (ETS) family transcription factor. The ETV6 protein has two function domains: an N-terminal pointed (PNT) domain that is involved in protein-protein interactions with itself and other proteins, and a C-terminal DNA-binding domain. Gene knockout studies in mice suggest that it is required for hematopoiesis and maintenance of the developing vascular network. The ETV6 gene is involved in a large number of chromosomal rearrangements associated with leukemia and congenital fibrosarcoma. The sequence of human ETV6 can be found at NM_001987.4 (nucleic acid; SEQ ID NO: 33) and NP_001978.1 (protein; SEQ ID NO: 34).

Some embodiments of all of the methods described herein involve the detection or determination of level, e.g., the presence (e.g., a level above a threshold, e.g., detectable, level) or absence (e.g., a level below a threshold level or an undetectable level) of ETV6 protein (or fragment thereof) or mRNA in a sample from the subject (e.g., in the serum of the subject). In these methods, the ETV6 protein that is detected can be, for example, a protein containing the sequence of SEQ ID NO: 34, or any fragment thereof (as described herein). In additional examples of these methods, the ETV6 mRNA that is detected can be, for example, a mRNA containing the sequence of SEQ ID NO: 33 (as described herein). In some embodiments of the invention, the ETV6 protein (or fragment thereof) or mRNA is absent or undetectable in an exosome (e.g., an exosome that is enriched from the sample).

Claudin-10

Claudin-10 protein plays a major role in tight junction-specific obliteration of the intercellular space, through calcium-independent cell-adhesion activity. Claudins are integral membrane proteins and components of tight junction strands. Tight junction strands serve as a physical barrier to prevent solutes and water from passing freely through paracellular space between epithelial or endothelial cell sheets, and also play critical roles in maintaining cell polarity and signal transductions. The expression of the claudin-10 gene is associated with recurrence of primary hepatocellular carcinoma.

Alternative splicing of claudin-10 mRNA results in multiple transcript variants. The human sequences are as follows: NM_182848.3 (nucleic acid; SEQ ID NO: 35) and NP_878268.1 (protein; SEQ ID NO: 36) for claudin-10 isoform a; NM_001160100.1 (nucleic acid; SEQ ID NO: 37) and NP_001153572.1 (protein; SEQ ID NO: 38) for claudin-10 isoform a-i1; and NM_006984.4 (nucleic acid; SEQ ID NO: 39) and NP_008915.1 (protein; SEQ ID NO: 40) for claudin-10 isoform b.

Some embodiments of all of the methods described herein involve the detection or determination of the level, e.g., the presence (e.g., a level above a threshold, e.g., detectable, level) or absence (e.g., a level below a threshold level or an undetectable level) of claudin-10 protein (or fragment thereof) or mRNA in a sample from the subject (e.g., in the serum of the subject). In these methods, the claudin-10 protein that is detected can be, for example, a protein containing the sequence of SEQ ID NO: 36, 38, or 40, or any fragment thereof (as described herein). In additional examples of these methods, the claudin-10 mRNA that is detected can be, for example, a mRNA containing the sequence of SEQ ID NO: 35, 37, or 39 (as described herein). In some embodiments of the invention, the claudin-10 protein (or fragment thereof) or mRNA is absent or undetectable in an exosome (e.g., an exosome that is enriched from the sample).

Microtubule-Associated Protein 9 (MAP9)

Microtubule-associated protein 9 is a member of a family of proteins that bind to tubulin subunits that make up microtubules. The members of this family of proteins regulate the stability of microtubules in the cell. The sequence of human MAP9 can be found at NM_001039580.1 and BC146864 (nucleic acid; SEQ ID NO: 57 and SEQ ID NO: 58), and NP_001034669.1 and AAI46865.1 (protein; SEQ ID NO: 59 and SEQ ID NO: 60).

Some embodiments of all of the methods described herein involve the detection or determination of the level, e.g., the presence (e.g., a level above a threshold, e.g., detectable, level) or absence (e.g., a level below a threshold level or an undetectable level) of MAP9 protein (or fragment thereof) or mRNA in a sample from the subject (e.g., in the serum of the subject). In these methods, the MAP9 protein that is detected can be, for example, a protein containing the sequence of SEQ ID NO: 59 or SEQ ID NO: 60, or any fragment thereof (as described herein). In additional examples of these methods, the MAP9 mRNA that is detected can be, for example, a mRNA containing the sequence of SEQ ID NO: 57 or SEQ ID NO: 58 (as described herein). In some embodiments of the invention, the MAP9 protein (or fragment thereof) or mRNA is absent or undetectable in an exosome (e.g., an exosome that is enriched from the sample).

Coiled-Coil Domain-Containing Protein 13 (CCDC13)

There is little information available about the activity of CCDC13 protein. The sequence of human MAP9 can be found at NM_144719.3 and BC036050.1 (nucleic acid; SEQ ID NO: 61 and SEQ ID NO: 62), and NP_653320.3 and AAH36050.1 (protein; SEQ ID NO: 63 and SEQ ID NO: 64).

Some embodiments of all of the methods described herein involve the detection or determination of the level, e.g., the presence (e.g., a level above a threshold, e.g., detectable, level) or absence (e.g., a level below a threshold level or an undetectable level) of CCDC13 protein (or fragment thereof) or mRNA in a sample from the subject (e.g., in the serum of the subject). In these methods, the CCDC13 protein that is detected can be, for example, a protein containing the sequence of SEQ ID NO: 63 or SEQ ID NO: 64, or any fragment thereof (as described herein). In additional examples of these methods, the CCDC13 mRNA that is detected can be, for example, a mRNA containing the sequence of SEQ ID NO: 61 or SEQ ID NO: 62 (as described herein). In some embodiments of the invention, the CCDC13 protein (or fragment thereof) or mRNA is absent or undetectable in an exosome (e.g., an exosome that is enriched from the sample).

Inositol Hexakisphosphate and Diphosphoinositol Kinase Isoform-2 (HISPPD1)

Inositol hexakisphosphate and diphosphoinositol kinase isoform-2 (HISPPD1) protein catalyzes the formation of disphosphinositol pentakisphosphate and bi-diphosphoinositol tetrakisphosphate. HISPPD1 is also known by the acronym PPIP5K2. The sequence of human HISPDD1 can be found at NM_015216.2 (nucleic acid; SEQ ID NO: 65) and NP_056031.2 (protein; SEQ ID NO: 66).

Some embodiments of all of the methods described herein involve the detection or determination of the level, e.g., the presence (e.g., a level above a threshold, e.g., detectable, level) or absence (e.g., a level below a threshold level or an undetectable level) of HISPPD1 protein (or fragment thereof) or mRNA in a sample from the subject (e.g., in the serum of the subject). In these methods, the HISPPD1 protein that is detected can be, for example, a protein containing the sequence of SEQ ID NO: 66, or any fragment thereof (as described herein). In additional examples of these methods, the HISPPD1 mRNA that is detected can be, for example, a mRNA containing the sequence of SEQ ID NO: 65 (as described herein). In some embodiments of the invention, the HISPPD1 protein (or fragment thereof) or mRNA is absent or undetectable in an exosome (e.g., an exosome that is enriched from the sample).

XP_002348181

Some embodiments of all of the methods described herein involve the detection or determination of the level, e.g., the presence (e.g., a level above a threshold, e.g., detectable, level) or absence (e.g., a level below a threshold level or an undetectable level) of XP_002348181 protein (or fragment thereof) or mRNA in a sample from the subject (e.g., in the serum of the subject). In these methods, the XP_002348181 protein that is detected can be, for example, a protein containing the sequence of SEQ ID NO: 68, or any fragment thereof (as described herein). In additional examples of these methods, the XP_002348181 mRNA that is detected can be, for example, a mRNA containing the sequence of SEQ ID NO: 67 (as described herein). In some embodiments of the invention, the XP_002348181 protein (or fragment thereof) or mRNA is absent or undetectable in an exosome (e.g., an exosome that is enriched from the sample).

Cysteine and Histidine-Rich Protein 1 (CYHR1)

Some embodiments of all of the methods described herein involve the detection or determination of the level, e.g., the presence (e.g., a level above a threshold, e.g., detectable, level) or absence (e.g., a level below a threshold level or an undetectable level) of cysteine and histidine-rich protein 1 (CYHR1) protein (or fragment thereof) or mRNA in a sample from the subject (e.g., in the serum of the subject). In these methods, the CYHR1 protein that is detected can be, for example, a protein containing the sequence of SEQ ID NO: 72, SEQ ID NO: 73, or SEQ ID NO: 74, or any fragment thereof (as described herein). In additional examples of these methods, the CYHR1 mRNA that is detected can be, for example, a mRNA containing the sequence of SEQ ID NO: 69, SEQ ID NO: 70, or SEQ ID NO: 71 (as described herein). In some embodiments of the invention, the CYHR1 protein (or fragment thereof) or mRNA is absent or undetectable in an exosome (e.g., an exosome that is enriched from the sample).

Immunoglobulin Gamma-3 Chain C (IGHG3)

Some embodiments of all of the methods described herein involve the detection or determination of the level, e.g., the presence (e.g., a level above a threshold, e.g., detectable, level) or absence (e.g., a level below a threshold level or an undetectable level) of immunoglobulin gamma-3 chain C region (IGHG3) protein (or fragment thereof) or mRNA in a sample from the subject (e.g., in the serum of the subject). In these methods, the IGHG3 protein that is detected can be, for example, a protein containing the sequence of SEQ ID NO: 78, SEQ ID NO: 79, or SEQ ID NO: 80, or any fragment thereof (as described herein). In additional examples of these methods, the IGHG3 mRNA that is detected can be, for example, a mRNA containing the sequence of SEQ ID NO: 75, SEQ ID NO: 76, or SEQ ID NO: 77 (as described herein). In some embodiments of the invention, the IGHG3 protein (or fragment thereof) or mRNA is absent or undetectable in an exosome (e.g., an exosome that is enriched from the sample).

Methods of Predicting Pre-Term Birth

Provided herein are methods of predicting the risk of pre-term birth in a pregnant subject that include providing a sample (e.g., a sample containing a biological fluid, e.g., serum or plasma) from the subject and detecting the level, e.g., the presence (e.g., a level above a threshold, e.g., detectable, level) or absence (e.g., a level below a threshold level or an undetectable level) of one or more (e.g., one, two, three, four, five, six, seven, eight, nine, ten, eleven, twelve, thirteen, fourteen, fifteen, sixteen, or seventeen) of GAS1, AFF3, TTR, RYR1, ETV6, claudin-10, ZNF23, COL27A1, Kazrin isoform-1, KRTAP10-9, HTT, MAP9, CCDC13, HISPPD1, IGHG3, CYHR1, and XP_002348181 (protein (or fragment thereof) or mRNA) in the sample, wherein the presence (e.g., above a threshold, e.g., detectable, level) of one or more (e.g., one, two, three, four, five, six, seven, eight, nine, ten, eleven, or twelve) of GAS1, AFF3, TTR, RYR1, ZNF23, COL27A1, Kazrin isoform-1, KRTAP10-9, HTT, IGHG3, CYHR1, and XP_002348181 in the sample, and/or the absence (e.g., below a threshold, e.g., detectable, level) of one or more (e.g., one, two, three, four, or five) of ETV6, claudin-10, MAP9, CCDC13, and HISPPD1 indicate that the pregnant subject has an increased risk of pre-term birth. Some embodiments further include determining the level, e.g., the presence (e.g., a level above a threshold, e.g., detectable, level) or absence (e.g., a level below a threshold level or an undetectable level) of fibronectin in the sample, wherein the presence of fibronectin in the sample further indicates that the pregnant subject has an increased risk of pre-term birth. In some embodiments, the methods include enriching the sample for exosomes, and detecting the level, e.g., the presence (e.g., a level above a threshold, e.g., detectable, level) or absence (e.g., a level below a threshold level or an undetectable level) of the biomarkers in the exosome-enriched sample. In some embodiments, the one or more of GAS1, AFF3, TTR, RYR1, ETV6, fibronectin, claudin-10, ZNF23, COL27A1, Kazrin isoform-1, KRTAP10-9, HTT, MAP9, CCDC13, HISPPD1, IGHG3, CYHR1, and XP_002348181 detected is within or associated with an exosome present in the sample, e.g., in an exosome-enriched sample, from the subject.

Similarly, the presence (e.g., above a threshold, e.g., detectable, level) of one or more (e.g., one, two, three, four, five, six, seven, eight, nine, ten, eleven, or twelve) of GAS1, AFF3, TTR, RYR1, ZNF23, COL27A1, Kazrin isoform-1, KRTAP10-9, HTT, IGHG3, CYHR1, and XP_002348181 in the sample, and/or the absence (e.g., below a threshold, e.g., detectable, level) of one or more (e.g., one, two, three, four, or five) of ETV6, claudin-10, MAP9, CCDC13, and HISPPD1, can identify a pregnant subject having an increased risk of pre-term birth. In some embodiments where the level, e.g., the presence (e.g., a level above a threshold, e.g., detectable, level) or absence (e.g., a level below a threshold level or an undetectable level) of fibronectin is further determined, the presence of fibronectin (e.g., above a threshold, e.g., detectable, level) in the sample further identifies a pregnant subject having an increased risk of pre-term birth. In some embodiments, the one or more of GAS1, AFF3, fibronectin, TTR, RYR1, ETV6, claudin-10, ZNF23, COL27A1, Kazrin isoform-1, KRTAP10-9, HTT, MAP9, CCDC13, HISPPD1, IGHG3, CYHR1, and XP_002348181 detected is within or associated with an exosome present in the sample from the subject.

Also provided are methods of identifying a pregnant subject at risk (e.g., having an increased risk of pre-term birth relative to a control population) of pre-term birth that include providing a sample (e.g., a sample containing a biological fluid, e.g., serum or plasma) from the subject and detecting the level, e.g., the presence (e.g., a level above a threshold, e.g., detectable, level) or absence (e.g., a level below a threshold level or an undetectable level) of one or more (e.g., one, two, three, four, five, six, seven, eight, nine, ten, eleven, twelve, thirteen, fourteen, fifteen, sixteen, or seventeen) of GAS1, ARR3, TTR, RYR1, ETV6, claudin-10, ZNF23, COL27A1, Kazrin isoform-1, KRTAP10-9, HTT, MAP9, CCDC13, HISPPD1, IGHG3, CYHR1, and XP_002348181 (protein or mRNA) in the sample (e.g., in exosomes enriched from the sample), wherein the presence (e.g., a level above a threshold or detectable level) of one or more (e.g., one, two, three, four, five, six, seven, eight, nine, ten, eleven, or twelve) of GAS1, ARR3, TTR, RYR1, ZNF23, COL27A1, Kazrin isoform-1, KRTAP10-9, HTT, IGHG3, CYHR1, and XP_002348181 (protein or mRNA), and/or the absence (e.g., a level below a threshold or detectable level, e.g., an undetectable level) of one or more (e.g., one, two, three, four, or five) of ETV6, claudin-10, MAP9, CCDC13, and HISPPD1 in the sample identifies the pregnant subject as having an increased (e.g., a statistically significant increase, such as an increase of at least 5%, 10%, 15%, 20%, 25%, 30%, 35%, 40%, 45%, 50%, 55%, 60%, 65%, 70%, 75%, 80%, 85%, 90%, 95%, or 100%) risk of pre-term birth. Some embodiments further include determining the level, e.g., the presence (e.g., a level above a threshold, e.g., detectable, level) or absence (e.g., a level below a threshold level or an undetectable level) of fibronectin in the sample, wherein the presence (e.g., a level above a threshold or detectable level) of fibronectin in the sample further identifies the pregnant subject as having an increased (e.g., a statistically significant increase) risk of pre-term birth. In some embodiments, the methods include enriching the sample for exosomes, and detecting the level, e.g., the presence (e.g., a level above a threshold, e.g., detectable, level) or absence (e.g., a level below a threshold level or an undetectable level) of the biomarkers in the exosome-enriched sample. In some embodiments, the one or more of GAS1, AFF3, TTR, RYR1, ETV6, fibronectin, claudin-10, ZNF23, COL27A1, Kazrin isoform-1, KRTAP10-9, HTT, MAP9, CCDC13, HISPPD1, IGHG3, CYHR1, and XP_002348181 detected is within or associated with an exosome present in the sample, e.g., in an exosome-enriched sample, from the subject.

Also provided are methods of selecting a subject (e.g., a pregnant subject) for participation in a clinical study that include providing a sample (e.g., a sample containing a biological fluid, e.g., serum or plasma) from the subject, detecting the level, e.g., the presence (e.g., a level above a threshold, e.g., detectable, level) or absence (e.g., a level below a threshold level or an undetectable level) of one or more (e.g., one, two, three, four, five, six, seven, eight, nine, ten, eleven, twelve, thirteen, fourteen, fifteen, sixteen, or seventeen) of GAS1, ARR3, TTR, RYR1, ETV6, claudin-10, ZNF23, COL27A1, Kazrin isoform-1, KRTAP10-9, HTT, MAP9, CCDC13, HISPPD1, IGHG3, CYHR1, and XP_002348181 (protein or mRNA) in the sample (e.g., in an exosome-enriched sample), and selecting a subject having one or more (e.g., one, two, three, four, five, six, seven, eight, nine, ten, eleven, or twelve) of GAS1, ARR3, TTR, RYR1, ZNF23, COL27A1, Kazrin isoform-1, KRTAP10-9, HTT, IGHG3, CYHR1, and XP_002348181 (protein or mRNA) present (e.g., above a threshold or detectable level) in the sample, and/or not having one or more (e.g., one, two, three, four, or five) of ETV6, claudin-10, MAP9, CCDC13, and HISPPD1 (e.g., below a threshold or detectable level) in the sample for participation in a clinical study. Some embodiments further include determining the level, e.g., the presence (e.g., a level above a threshold, e.g., detectable, level) or absence (e.g., a level below a threshold level or an undetectable level) of fibronectin in the sample, and selecting a subject having fibronectin present (e.g., above a threshold or detectable level) in the sample, and having one or more (e.g., one, two, three, four, five, six, seven, eight, nine, ten, eleven, or twelve) of GAS1, AFF3, TTR, RYR1, ZNF23, COL27A1, Kazrin isoform-1, KRTAP10-9, HTT, IGHG3, CYHR1, and XP_002348181 present (e.g., above a threshold or detectable level) in the sample, and/or not having one or more (e.g., one, two, three, four, or five) of ETV6, claudin-10, MAP9, CCDC13, and HISPPD1 (e.g., below a threshold or detectable level) in the sample, for participation in a clinical study. In some embodiments, the methods include enriching the sample for exosomes, and detecting the level, e.g., the presence (e.g., a level above a threshold, e.g., detectable, level) or absence (e.g., a level below a threshold level or an undetectable level) of the biomarkers in the exosome-enriched sample. In some embodiments, the one or more of GAS1, AFF3, TTR, RYR1, ETV6, fibronectin, claudin-10, ZNF23, COL27A1, Kazrin isoform-1, KRTAP10-9, HTT, MAP9, CCDC13, HISPPD1, IGHG3, CYHR1, and XP_002348181 detected is within or associated with an exosome present in the sample, e.g., an exosome-enriched sample, from the subject.

Subjects

In some embodiments of all of the methods described herein, the subject is a pregnant woman in the first (weeks 0-12 of gestation) or second (weeks 13-27 of gestation) trimester of pregnancy (e.g., any time between 0 to 20 weeks, 6 to 20 weeks, 6 to 12 weeks, or 24-27 weeks of gestation). In some embodiments the subject is a pregnant woman between 27-37 weeks of gestation (e.g., 27-32 weeks or 33 to 37 weeks of gestation). In some embodiments of all of the methods described herein, the subject is between 5 to 8 weeks or 15 to 18 weeks of gestation. In some embodiments of all of the methods described herein, the subject is within the first 20 weeks of gestation (e.g., within 3 weeks, 4 weeks, 5 weeks, 6 weeks, 7 weeks, 8 weeks, 9 weeks, 10 weeks, 11 weeks, 12 weeks, 13 weeks, 14 weeks, 15 weeks, 16 weeks, 17 weeks, 18 weeks, or 19 weeks of gestation). The stage of gestation can be assessed from the date of a women's last menstruation (using methods known in the art). Alternatively, the stage of gestation can be determined by ultrasonography using methods known in the art.

The subject can also have had at least one (e.g., two, three, four, five, or six) pre-term birth. In some embodiments, the subject may be in her first pregnancy. In some embodiments, the pregnant subject is within the first 37 weeks of gestation (e.g., within 3 weeks, 4 weeks, 5 weeks, 6 weeks, 7 weeks, 8 weeks, 9 weeks, 10 weeks, 11 weeks, 12 weeks, 13 weeks, 14 weeks, 15 weeks, 16 weeks, 17 weeks, 18 weeks, 19 weeks, 20 weeks, 21 weeks, 22 weeks, 23 weeks, 24 weeks, 25 weeks, 26 weeks, 27 weeks, 28 weeks, 29 weeks, 30 weeks, 31 weeks, 32 weeks, 33 weeks, 34 weeks, 35 weeks, or 36 weeks of gestation) and has had at least one (e.g., two, three, four, five, or six) pre-term birth.

In some embodiments, the pregnant human subject is in the second or third trimester of gestation (e.g., weeks 13-37). In some embodiments, the subject is in gestational week 13 or later (e.g., week 13, week 14, week 15, week 16, week 17, week 18, week 19, week 20, weeks 21, week 22, week 23, week 24, week 25, week 26, week 27, week 28, week 29, week 30, week 31, week 32, week 33, week 34, week 35, week 36 or later, but earlier than week 38). In some embodiments, the subject is in gestational week 37 or earlier (e.g., week 37, week 36, week 35, week 34, week 33, week 32, week 31, week 30, week 29, week 28, week 27, week 26, week 25, week 24, week 23, week 22, week 21, week 20, week 19, week 18, week 17, week 16, week 15, week 14 or earlier, but later than week 12). In some embodiments the subject has had at least one (e.g., two, three, four, five, or six) pre-term birth. In some embodiments the subject has had at least one (e.g., two, three, four, five, or six) term birth. In some embodiments, the subject is primagravid (e.g., first pregnancy).

Sample Preparation and Assay Methods

A sample (e.g., a sample containing a biological fluid, e.g., serum or plasma) from the pregnant subject can be collected from the subject at any time during pregnancy (e.g., between weeks 5 to 8 of gestation, between weeks 15 to 18 of gestation, between weeks 18 to 27 of gestation, between weeks 27 to 37 of gestation, or within 3 weeks, 4 weeks, 5 weeks, 6 weeks, 7 weeks, 8 weeks, 9 weeks, 10 weeks, 11 weeks, 12 weeks, 13 weeks, 14 weeks, 15 weeks, 16 weeks, 17 weeks, 18 weeks, 19 weeks, 20 weeks, 21 weeks, 22 weeks, 23 weeks, 24 weeks, 25 weeks, 26 weeks, 27 weeks, 28 weeks, 29 weeks, 30 weeks, 31 weeks, 32 weeks, 33 weeks, 34 weeks, 35 weeks, or 36 weeks of gestation). Samples can be frozen or stored for a period of time (e.g., at least one day, two days, three days, four days, five days, six days, or 1 week) prior to detecting/determining the presence or absence of one or more of GAS1, AFF3, fibronectin, TTR, RYR1, ETV6, claudin-10, ZNF23, COL27A1, Kazrin isoform-1, KRTAP10-9, HTT, MAP9, CCDC13, HISPPD1, IGHG3, CYHR1, and XP_002348181 (protein or mRNA).

Any method known in the art can be used for detecting the presence of proteins (e.g., using one or more antibodies that specifically bind to GAS1, AFF3, fibronectin, TTR, RYR1, ETV6, claudin-10, ZNF23, COL27A1, Kazrin isoform-1, KRTAP10-9, HTT, MAP9, CCDC13, HISPPD1, IGHG3, CYHR1, or XP_002348181, or a fragment thereof) or mRNA in a sample (e.g., using one or more nucleic acids that are complementary to a sequence encoding GAS1, AFF3, fibronectin, TTR, RYR1, ETV6, claudin-10, ZNF23, COL27A1, Kazrin isoform-1, KRTAP10-9, HTT, MAP9, CCDC13, HISPPD1, IGHG3, CYHR1, XP_002348181). For example, a sample (e.g., a sample containing a biological fluid, e.g., serum, plasma, or blood) from a subject (e.g., any of the subjects described herein, such as a pregnant subject) can be contacted with one or more antibodies that specifically bind to GAS1, AFF3, fibronectin, TTR, RYR1, ETV6, claudin-10, ZNF23, COL27A1, Kazrin isoform-1, KRTAP10-9, HTT, MAP9, CCDC13, HISPPD1, IGHG3, CYHR1, or XP_002348181, or an antigenic portion thereof, the binding of the one or more antibodies to proteins present in the sample can be detected using methods known in the art.

In some embodiments of all of the methods described herein, the sample is contacted with one or more nucleic acids (e.g., primers or antisense molecules) that contain a sequence that is complementary to a contiguous sequence present in a mRNA encoding GAS1, AFF3, fibronectin, TTR, RYR1, ETV6, claudin-10, ZNF23, COL27A1, Kazrin isoform-1, KRTAP10-9, HTT, MAP9, CCDC13, HISPPD1, IGHG3, CYHR1, or XP_002348181 and, optionally, amplification is performed using a polymerase chain reaction (PCR)-based technique, as known in the art. Methods for measuring the presence or absence of a target mRNA in a biological sample are known in the art, for example, polymerase chain reaction (PCR)-based techniques (e.g., real-time quantitative PCR and gene array). Primers for use in the methods of measuring the presence or absence of a target mRNA can be designed based on the sequence of SEQ ID NO: 1, 3, 5, 7, 9, 11, 13, 15, 17, 19, 21, 23, 25, 27, 29, 31, 33, 35, 37, 39, 41, 43, 44, 47, 48, 51, 52, 55, 57, 58, 61, 62, or 65, using methods known in the art.

In some embodiments all of the methods described herein, an array (e.g., any array, microarray, biochip, or point-of-care test as is known in the art) can be provided that comprises one or more antibodies that specifically bind to GAS1, AFF3, fibronectin, TTR, RYR1, ETV6, claudin-10, ZNF23, COL27A1, Kazrin isoform-1, KRTAP10-9, HTT, MAP9, CCDC13, HISPPD1, IGHG3, CYHR1, or XP_002348181, and the array can be contacted with the sample (e.g., a sample containing a biological fluid, e.g., serum or plasma) from the subject, and the binding of any proteins present in the sample can be detected. Likewise, an array can be provided that comprises one or more nucleic acids (e.g., probes) that contain a sequence complementary to a contiguous sequence present in a mRNA encoding GAS1, AFF3, fibronectin, TTR, RYR1, ETV6, claudin-10, ZNF23, COL27A1, Kazrin isoform-1, KRTAP10-9, HTT, MAP9, CCDC13, HSPPD1, IGHG3, CYHR1, or XP_002348181, or a fragment thereof. The arrays can be used to develop a database of information using data obtained using the methods described herein.

Methods for detecting binding of the antibodies to target proteins are known in the art, and can include the use of secondary antibodies. The secondary antibodies are generally modified to be detectable, e.g., labeled. The term "labeled" is intended to encompass direct labeling by coupling (i.e., physically linking) a detectable substance to the secondary antibody, as well as indirect labeling of the multimeric antigen by reactivity with a detectable substance. Examples of detectable substances include various enzymes, prosthetic groups, fluorescent materials, luminescent materials, bioluminescent materials, and radioactive materials. Examples of suitable enzymes include horseradish peroxidase (HRP), alkaline phosphatase, β-galactosidase, and acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, and quantum dots, dichlorotriazinylamine fluorescein, dansyl chloride, and phycoerythrin; an example of a luminescent material includes luminol; examples of bioluminescent materials include green fluorescent protein and variants thereof, luciferase, luciferin, and aequorin; and examples of suitable radioactive material include $^{125}I$, $^{131}I$, $^{35}S$, or $^{3}H$. Methods for producing such labeled antibodies are known in the art, and many are commercially available.

Any method of detecting proteins present in a sample can be used, including but not limited to radioimmunoassays (RIA), enzyme-linked immunosorbent assays (ELISA), Western blotting, surface plasmon resonance, microfluidic devices, protein array, protein purification (e.g., chromatography, such as affinity chromatography), mass spectrometry, two-dimensional gel electrophoresis, or other assays as known in the art.

The term "array," as used herein, generally refers to a predetermined spatial arrangement of binding ligands (e.g., antibodies or nucleic acid probes) or spatial arrangements of binding ligands or antigens. Arrays according to the present invention include antibodies or nucleic acid probes immobilized on a surface may also be referred to as "antibody arrays" or "gene arrays," respectively. Arrays according to the present invention that comprise surfaces activated, adapted, prepared, or modified to facilitate the binding of sample proteins or nucleic acids to the surface may also be referred to as "binding arrays." Further, the term "array" can be used herein to refer to multiple arrays arranged on a surface, such as would be the case where a surface bore multiple copies of an array. Such surfaces bearing multiple arrays may also be referred to as "multiple arrays" or "repeating arrays." The use of the term "array" herein can encompass antibody arrays, gene arrays, binding arrays, multiple arrays, and any combination thereof; the appropriate meaning will be apparent from context. An array can include antibodies that detect proteins or nucleic acid probes that detect mRNAs altered in a pregnant subject who is likely to experience pre-term birth. The array can be contacted with one or more samples from a subject; the samples can include fluid or solid samples from any tissue of the body including excretory fluids such as urine. Non-urine samples include, but are not limited to serum, plasma, amniotic fluid, and placental tissue.

An array of the invention comprises a substrate. By "substrate" or "solid support" or other grammatical equivalents, herein is meant any material appropriate for the attachment of antibodies or nucleic acid probes and is amenable to at least one detection method. As will be appreciated by those in the art, the number of possible substrates is very large. Possible substrates include, but are not limited to, glass and modified or functionalized glass, plastics (including acrylics, polystyrene, and copolymers of styrene and other materials, polypropylene, polyethylene, polybutylene, polyurethanes, TEFLON®, etc.), polysaccharides, nylon or nitrocellulose, resins, silica or silica-based materials including silicon and modified silicon, carbon, metals, inorganic glasses, plastics, ceramics, and a variety of other polymers. In addition, as is known the art, the substrate can be coated with any number of materials, including polymers, such as dextrans, acrylamides, gelatins, or agarose. Such coatings can facilitate the use of the array with a sample derived from a biological fluid, e.g., urine, plasma, or serum.

A planar array of the invention will generally contain addressable locations (e.g., "pads," "addresses," or "microlocations") of antibodies or nucleic acid probes in an array format. The size of the array will depend on the composition and end use of the array. The arrays can contain one, two, or more different antibodies or nucleic acid probes. Generally, the array will comprise from two to as many as 20 different antibodies or nucleic acid probes, depending on the end use of the array. A microarray of the invention will generally comprise at least one antibody or nucleic acid probe that identifies or "captures" a target protein or mRNA present in a biological sample. In some embodiments, the compositions of the invention may not be in an array format; that is, for some embodiments, compositions comprising a single antibody or nucleic acid probe can be made as well. In addition, in some arrays, multiple substrates can be used, either of different or identical compositions. Thus, for example, large planar arrays can comprise a plurality of smaller substrates.

As an alternative to planar arrays, bead-based assays in combination with flow cytometry have been developed to perform multiparametric immunoassays. In bead-based assay systems, one or more antibodies can be immobilized on addressable microspheres. Each antibody for each individual immunoassay is coupled to a distinct type of microsphere (i.e., "microbead") and the immunoassay reaction takes place on the surface of the microspheres. Dyed microspheres with discrete fluorescence intensities are loaded separately with their appropriate biomolecules. The different bead sets carrying different capture probes (e.g., antibodies) can be pooled as necessary to generate custom bead arrays. Bead arrays are then incubated with the sample in a single reaction vessel to perform the immunoassay.

In some embodiments, product formation of the target protein with an antibody can be detected with a fluorescence-based reporter system. The antibodies can be labeled directly by a fluorogen or detected by a second fluorescently-labeled capture biomolecule. The signal intensities derived from target-bound antibodies are measured in a flow cytometer. The flow cytometer first identifies each microsphere by its individual color code. Second the amount of antibody on each individual bead is measured by the second color fluorescence specific for the bound target. This allows multiplexed quantitation of multiple targets from a single sample within the same experiment. Sensitivity, reliability, and accuracy are comparable to standard microtiter ELISA procedures. With bead-based immunoassay systems, proteins can be simultaneously quantified from biological samples. An advantage of bead-based systems is the individual coupling of an antibody to distinct microspheres.

Thus, microbead array technology can be used to sort proteins bound to specific antibodies using a plurality of microbeads, each of which can carry about 100,000 identical molecules of a specific antibody on its surface. Once captured, the protein can be handled as a fluid, referred to herein as a "fluid microarray."

An array can encompass any means for detecting a protein. For example, microarrays can be biochips that provide high-density immobilized arrays of antibodies, where antibody binding is monitored indirectly (e.g., via fluorescence). In addition, an array can be of a format that involves the capture of target proteins by biochemical or intermolecular interaction, coupled with direct detection by mass spectrometry (MS).

Arrays and microarrays that can be used with the methods described herein can be made according to the methods described in U.S. Pat. Nos. 6,329,209; 6,365,418; 6,406,921; 6,475,808; and 6,475,809, which are incorporated herein in their entirety. New arrays, to detect specific selections or sets of biomarkers described herein can also be made using the methods described in these patents.

The antibodies can be immobilized on the surface using methods and materials that minimize the denaturing of the antibodies, that minimize alterations in the structure of the antibodies, or that minimize interactions between the antibodies and the surface on which they are immobilized.

Surfaces useful in the arrays can be of any desired shape (form) and size. Non-limiting examples of surfaces include chips, continuous surfaces, curved surfaces, flexible surfaces, films, plates, sheets, tubes, and the like. Surfaces preferably have areas ranging from approximately a square micron to approximately 500 $cm^2$. The area, length, and width of surfaces according to the present invention can be varied according to the requirements of the assay to be performed. Considerations may include, for example, ease of handling, limitations of the material(s) of which the surface is formed, requirements of detection systems, requirements of deposition systems (e.g., arrayers), and the like.

In certain embodiments, it is desirable to employ a physical means for separating groups or arrays of binding islands or immobilized antibodies or nucleic acid probes: such physical separation facilitates exposure of different groups or arrays to different solutions of interest. Therefore, in certain embodiments, arrays are situated within wells of 96-, 384-, 1536-, or 3456-microwell plates. In such embodiments, the bottoms of the wells can serve as surfaces for the formation of arrays, or arrays can be formed on other surfaces and then placed into wells. In certain embodiments, such as where a surface without wells is used, binding islands can be formed or antibodies or nucleic acid probes can be immobilized on a surface and a gasket having holes spatially arranged so that they correspond to the islands or antibodies/nucleic acid probes can be placed on the surface. Such a gasket is preferably liquid-tight. A gasket can be placed on a surface at any time during the process of making the array and can be removed if separation of groups or arrays is no longer necessary.

The immobilized antibodies or nucleic acid probes can bind to proteins or mRNAs present in a biological sample overlying the immobilized antibodies/nucleic acid probes. For example, a target protein or mRNA present in a biological sample can contact an immobilized antibody or nucleic acid probe and bind to it, thereby facilitating detection of the target protein or mRNA.

Modifications or binding of target proteins or mRNAs to antibodies or nucleic acid probes in solution or immobilized on an array can be detected using detection techniques known in the art. Examples of such techniques include immunological techniques such as competitive binding assays and sandwich assays; fluorescence detection using instruments such as confocal scanners, confocal microscopes, or CCD-based systems, and techniques such as fluorescence, fluorescence polarization (FP), fluorescence resonant energy transfer (FRET), total internal reflection fluorescence (TIRF), fluorescence correlation spectroscopy (FCS); colorimetric/spectrometric techniques; surface plasmon resonance, by which changes in mass of materials adsorbed at surfaces can be measured; techniques using radioisotopes, including conventional radioisotope binding and scintillation proximity assays (SPA); mass spectroscopy, such as matrix-assisted laser desorption/ionization mass spectroscopy (MALDI) and MALDI-time of flight (TOF) mass spectroscopy; ellipsometry, which is an optical method of measuring thickness of protein films; quartz crystal microbalance (QCM), a very sensitive method for measuring mass of materials adsorbing to surfaces; scanning probe microscopies, such as atomic force microscopy (AFM) and scanning electron microscopy (SEM); and techniques such as electrochemical, impedance, acoustic, microwave, and infrared (IR)/Raman detection. See, e.g., Mere L, et al., "Miniaturized FRET assays and microfluidics: key components for ultra-high-throughput screening," *Drug Discovery Today* 4(8):363-369, 1999, and references cited therein; Lakowicz, J. R., Principles of Fluorescence Spectroscopy, 2nd Edition, Plenum Press, 1999.

Arrays as described herein can be included in kits. Such kits can also include, as non-limiting examples, one or more of: reagents useful for preparing antibodies or nucleic acid probes for immobilization onto binding islands or areas of an array, reagents useful in preparing a sample, reagents useful for enriching exosomes, reagents useful for detecting binding of target proteins or mRNAs in a sample to immobilized antibodies or nucleic acid probes, control samples that include purified target proteins or nucleic acids, and/or instructions for use.

For example, kits useful in the methods described herein can include one or more (e.g., two, three, four, five, six, seven, eight, nine, ten, eleven, twelve, thirteen, fourteen, or fifteen) antibodies or nucleic acid probes (e.g., a sequence complementary to a contiguous sequence present in a target mRNA) that specifically bind to GAS1, AFF3, fibronectin, TTR, RYR1, ETV6, claudin-10, ZNF23, COL27A1, Kazrin isoform-1, KRTAP10-9, HTT, MAP9, CCDC13, HISPPD1, IGHG3, CYHR1, or XP_002348181 (protein (or a fragment thereof) or mRNA). For example, the one or more antibodies or the one or more nucleic acid probes provided in the kits can be immobilized on a surface (e.g., in the form of an ELISA assay or a gene-chip array).

Enriching Exosomes

Any of the methods described herein can further include enriching exosomes from the sample, wherein the presence or absence of one or more of: GAS1, AFF3, fibronectin, TTR, RYR1, ETV6, claudin-10, ZNF23, COL27A1, Kazrin isoform-1, KRTAP10-9, HTT, MAP9, CCDC13, HISPPD1, IGHG3, CYHR1, and XP_002348181 (protein or mRNA) in the enriched exosomes is determined (e.g., using any of the methods described herein). A sample that is enriched in exosomes need not be 100% pure exosomes.

Exosomes can be enriched using any methods known in the art (see, for example the techniques described in Taylor et al., Serum/Plasma Proteomics, Chapter 15, "Exosome Isolation for Proteomic Analyses and RNA Profiling," Springer Science, 2011, and references cited therein). Exosomes can be enriched from a biological fluid from a subject, e.g., blood, plasma, serum, or ascites. In some embodiments, for the enrichment of exosomes from plasma using centrifugation, sodium heparin (1,000 m/L) can be added prior to isolation and the blood can be centrifuged at 12,000×g for 15 min at 4° C. to remove any cellular debris. The cell-free blood specimens can further be centrifuged at 100,000×g for 1 h at 4° C. The pellet containing exosomes can be resuspended in PBS, and recentrifuged at 100,000×g for 1 h at 4° C. The resulting exosome pellet can be used for TRIZOL extraction for RNA and protein determination (using any of the methods described herein).

In some embodiments, exosomes can also be enriched using size exclusion chromatography. In an exemplary method, 2 mL aliquots of patient-derived cell-free ascites or serum can be applied to a 2% agarose-based gel column (2.5×16 cm). For optimal separation, the sample volume should be ½₀ of the total column volume (as defined by IIr2h). The column can be eluted isocratically with PBS (e.g., at a flow rate of 1 mL/min), while monitoring absorbance at 280 nm, and collecting fractions (2 mL). The void volume fractions (based on absorbance at 280 nm) can be pooled and centrifuged at 100,000×g for 1 hour at 4° C. The resulting pellet (containing exosomes) can be used for TRIZOL extraction for RNA and protein analyses (using any of the methods described herein).

In some embodiments, exosomes can also be enriched using magnetic beads. In an examplary method, serum can be absorbed to anti-EpCAM antibodies coupled to magnetic microbeads. Anti-EpCAM coupled to microbeads (50 mL) can be added to the serum specimens (2 mL), mixed, and incubated on a shaker for 2 h at room temperature. Each tube is thereafter placed in the magnetic separator and fluid removed, leaving the magnetic beads and the bound exosomes attached to the side of the tube. The tube is then removed from the magnetic separator and the beads rinsed with 500 mL TBS, and the separation repeated. After the wash step, the tube is removed from the magnetic holder and the bead/exosome complex can be used for TRIZOL extraction for RNA and protein analyses (using any of the methods described herein).

In some embodiments, exosomes can also be enriched using precipitation. In one exemplary method, the specimen (2 mL ascites or serum) is transferred to a sterile tube and 0.5 mL ExoQuick exosome precipitation solution can be added and mixed. The mixture is then incubated overnight (at least 12 hours) at 4° C. and the mixture subsequently centrifuged at 10,000×g in a microfuge for 5 minutes at 4° C. The supernatant is aspirated and the exosome pellet can be extracted using the TRIZOL extraction procedures for protein and RNA analyses (using any of the methods described herein).

Total mRNA can be isolated from exosomes using methods known in the art, for example, TRIZOL according to manufacturer's instructions (Invitrogen), except with the isopropanol precipitation step extended to overnight. The mRNA quality and yield can be accessed using a GENEQUANT II. Methods for analyzing purified mRNAs are known in the art and include reverse transcription PCR, gene array analysis, and Northern blotting.

Exosomal protein isolation can be performed, for example, by continuing the TRIZOL isolation procedure, as described by the manufacturer. In some embodiments, the quantity of protein can be determined by the Bradford microassay method, using BSA as a standard. Any protein or mRNA isolation methods described herein or known in the art can be used to detect the presence or absence of a protein or mRNA in the enriched exosomes.

In any of the methods described herein, the presence (e.g., a level above a threshold, e.g., detectable, level) of one or more (e.g., one, two, three, four, five, six, seven, eight, nine, ten, eleven, or twelve) of GAS1, ARR3, TTR, RYR1, ZNF23, COL27A1, Kazrin isoform-1, KRTAP10-9, HTT, IGHG3, CYHR1, and XP_002348181 (protein or mRNA), and/or the absence (e.g., a level below a threshold, e.g., detectable, level) of one or more (e.g., one, two, three, four, or five) of ETV6, claudin-10, MAP9, CCDC13, and HISPPD1 in a sample from the pregnant subject, indicate that the pregnant subject has an increased risk of pre-term birth, or identifies a pregnant subject having an increased risk of pre-term birth. The additional presence of fibonectin further indicates that the pregnant subject has an increased risk of pre-term birth, or can be used to further identify a pregnant subject as having an increased risk of pre-term birth Methods for Decreasing the Risk of Pre-Term Birth Also provided are methods of decreasing the risk of pre-term birth in a pregnant subject that include providing a sample (e.g., a sample containing a biological fluid, e.g., serum, plasma, urine, amniotic fluid, or an excretion) from the subject, detecting the level, e.g., the presence (e.g., a level above a threshold, e.g., detectable, level) or absence (e.g., a level below a threshold level or an undetectable level) of one or more (e.g., one, two, three, four, five, six, seven, eight, nine, ten, eleven, twelve, thirteen, fourteen, fifteen, sixteen, or seventeen) of GAS1, ARR3, TTR, RYR1, ETV6, claudin-10, ZNF23, COL27A1, Kazrin isoform-1, KRTAP10-9, HTT, MAP9, CCDC13, HISPPD1, IGHG3, CYHR1, and XP_002348181 (protein or mRNA) in the sample (e.g., in exosomes enriched from the sample), and administering a therapeutic treatment to a pregnant subject having one or more (e.g., one, two, three, four, five, six, seven, eight, nine, ten, eleven, or twelve) of GAS1, ARR3, TTR, RYR1, ZNF23, COL27A1, Kazrin isoform-1, KRTAP10-9, HTT, IGHG3, CYHR1, and XP_002348181 (protein or mRNA) present (e.g., above a threshold, e.g., detectable, level) in the sample, and/or not having (e.g., below a threshold, e.g., detectable, level) one or more (e.g., one, two, three, four, or five) of ETV6, claudin-10, MAP9, CCDC13, and HISPPD1 (protein or mRNA) in the sample. Some embodiments of these methods further include determining the level, e.g., the presence (e.g., a level above a threshold, e.g., detectable, level) or absence (e.g., a level below a threshold level or an undetectable level) of fibronectin in the sample. In some embodiments, the methods include enriching the sample for exosomes, and detecting the level, e.g., the presence (e.g., a level above a threshold, e.g., detectable, level) or absence (e.g., a level below a threshold level or an undetectable level) of the biomarkers in the exosome-enriched sample. Once a subject has been determined to be at risk of pre-term birth, or for whom a pre-term birth is predicted, by a method described herein, the methods further include the administration of a therapeutic treatment to reduce the risk of pre-term birth.

The therapeutic treatment can be administered by a health care professional (e.g., a physician, a nurse, or a physician's assistant). The treatment can be administered in a patient's home or in a heath care facility (e.g., a hospital or a clinic). In some embodiments, the therapeutic treatment is a treatment that decreases or suppresses an immune response, e.g., that decreases inflammation, or decreases a Th1-type immune response, and/or enhances a Th2-type immune response.

Non-limiting examples of therapeutic treatment include complement inhibitors (e.g., antibodies that bind to complement components, such as C1, C3, and C5 (e.g., 5G1.1SC and 5G1.1 (Alexion), eculizumab, and pex-elizumab); soluble complement receptor 1, C1-inhibitor (C1-Inh), C1 esterase inhibitor, C3 inhibitor (POT-4), C5 complement inhibitor (Alexion), compstatin, heparin, and the complement inhibitors described in U.S. Pat. Nos. 4,146,640; 4,007,270; 4,241, 301; and 5,847,082; and U.S. Patent Application Publications Nos. 2007/0141573; 2009/0117098; and 2009/0214538), hormones (e.g., progesterone), steroids (e.g., prednisone), passive immunotherapy with intravenous immunoglobulin, aspirin (e.g., low-dose aspirin), and TNF antagonists (e.g., soluble fragments of TNF-α receptors (e.g., etanercept) and antibodies that specifically bind to TNF-α (e.g., adalimumab and infliximab), and small molecule inhibitors of TNF-α (e.g., pentoxyfyllene)). One or more (e.g., two, three, four, or five) therapeutic treatments can be administered to the pregnant subject. In some methods, the subject is within the first 1 week of gestation, 2 weeks, 3 weeks, 4 weeks, 5 weeks, 6 weeks, 7 weeks, 8 weeks, 9 weeks, 10 weeks, 11 weeks, 12 weeks, 13 weeks, 14 weeks, 15 weeks, 16 weeks, 17 weeks, 18 weeks, 19 weeks, 20 weeks, 24 weeks, 30 weeks, or 36 weeks of gestation.

The dosage of the therapeutic treatment can be determined by a health care professional based on the treatment selected and factors known in the art (for a general review of exemplary treatments, see, Tincani et al., *Clinic Rev. Allerg. Immunol.* 39:153-159, 2010; Stephenson et al., *Human Reproduction* 25:2203-2209, 2010; and Dukhovny et al., *Curr. Opin. Endocrinol. Diabetes Obes.* 16:451-458, 2009). For example, a pregnant subject identified for the administration of a therapeutic treatment using the provided methods, can be intravenously administered passive immunoglobulin one or more times (e.g., two, three, four, or five times) during and/or prior to pregnancy (as described herein). A physician can monitor the subject (e.g., using the methods to determine risk of pre-term birth described herein) to determine whether the dosage or the frequency of therapeutic treatment should be altered (e.g., increase in the dosage and/or frequency of administration of a therapeutic treatment for those pregnant subjects indicated as having an increased risk of pre-term birth) during a given time frame (e.g., during the term of the pregnancy (e.g., anywhere from between conception to 37 weeks of gestation, between conception and up to 8 months of gestation, between conception and up to 7 months of gestation, between conception up to 6 months of gestation, between conception up to 5 months of gestation, between conception up to 4 months of gestation, between conception up to 3 months of gestation, between conception and up to 2 months of gestation, between 3 and 20 weeks of gestation, between 6 to 8 weeks of gestation, between 5 and 20 weeks of gestation, between 10 and 20 weeks of gestation, or between 15 and 17 weeks of gestation), a period of time beginning at conception to the end of the term or a time point during the term of the pregnancy (e.g., anywhere from between conception to 9 months of gestation, between conception and up to 8 months of gestation, between conception up to 7 months of gestation, between conception up to 6 months of gestation, between conception up to 5 months of gestation, between conception up to 4 months of gestation, between conception up to 3 months of gestation, between conception and up to 2 months of gestation, between 3 and 20 weeks of gestation, between 5 and 20 weeks of gestation, between 6 and 8 weeks of gestation, between 10 and 20 weeks of gestation, or between 15 and 18 weeks of gestation).

The decrease in risk of pre-term birth in a pregnant subject can be compared to control subjects not receiving the therapeutic treatment (e.g., a group of control subjects that have one or more of GAS1, ARR3, fibronectin, transthyretin, RYR1, ZNF23, COL27A1, Kazrin isoform-1, KRTAP10-9, HTT, IGHG3, CYHR1, and XP_002348181 present (e.g., at levels above a threshold level or detectable level) in a sample, and/or do not have one or more of ETV6, claudin-10, MAP9, CCDC13, and HISPPD1 present (e.g., at levels below a threshold level or detectable level) in the sample, or a group of pregnant control subjects that have a pre-term birth).

EXAMPLES

The invention is further described in the following examples, which do not limit the scope of the invention described in the claims.

Example 1

Proteomic Analysis of Exosomal Proteins in Women Having Pre-Term Birth and Women Having Term Birth Previous data suggest that aberrant immune regulation exists in a subpopulation of pregnant women that could lead to preterm labor and birth, and such aberrations might increase the risk of infections, including development of periodontal disease (Moore et al., *Brit. Dent. J.* 197:251-258, 2004; Moore et al., *Brit. J. Obstet. Gynecol.* 111:125-132, 2004). Studies on the immunophenotypic profile in normal pregnancies versus pre-term births demonstrate that the suppressive immunophenotypic profile observed in normal term pregnancies is absent or impaired in preterm births (Blidaru et al., *Revista Medico-Chirurgicala a Soc. Ned. Si Naturalisti Din Iasi* 107:343-347, 2002). Consistent with this observation, peripheral blood lymphocytes (PBL) of women delivering pre-term exhibited significantly increased cytotoxic activity than PBL from women delivering at term (Szekeres-Bartho et al., *Am. J. Reprod. Immunol.* 2:102-103, 1982). This same trend was also observed for NK cell activity (Szekeres-Bartho et al., *Am. J. Reprod. Immunol.* 7:22-26, 1985).

One physiological feature that has received little attention as a potential immune regulator as well as marker of pregnancy outcomes is the presence of circulating exosomes derived from the placenta, which appear to be important features of intercellular communication. Since released exosomes express molecules with biological activity (such as Fas ligand, programmed death-1 (PD-1), MHC class I polypeptide-related sequence A/B (MICA/B), multiple drug resistance 1 (mdr1), matrix metalloproteinases (MMPs), CD44, and autoreactive antigens) (Denzer et al., *J. Cell Sci.* 113:3365-3374, 2000; Frangsmyr et al., *Mol. Human Reprod.* 11:35-41, 2005; Hedlund et al., *J. Immunol.* 183:340-351, 2009), the ability of these microvesicles to modulate the microenvironment of the decidua, including the modulation of lymphocyte and monocyte function, may be determinative of pregnancy outcome. It has been theorized that these released exosomes modulate lymphocyte functions by mimicking "activation-induced cell death" (AICD) (Gorak-Stolinska et al., *J. Leuk. Biol.* 70:756-766, 2001).

Lymphoid cells appear to release exosomes following activation, and these exosomes appear to play an essential role in immunoregulation, by preventing excessive immune responses and the development of autoimmunity (Gorak-Stolinska et al., *J. Leuk. Biol.* 70:756-766, 2001). It has been postulated that exosome release by placental cells may circumvent immunosurveillance (Gercel-Taylor et al., *J. Reprod. Immunol.* 56:29-44, 2002).

Placental exosomes in the peripheral circulation of pregnant patients are enriched in FasL during the second and third trimester, and the presence and levels of FasL-positive exosomes appear to correlate with T-cell apoptosis and suppression of zeta expression (Abrahams et al., *Mol. Hum. Reprod.* 10:55-63, 2004). In vitro exposure of T-cells to exosomes induced apoptosis, as well as increased expression and activation of caspase-3 and loss of mitochondrial membrane potential. Analyses of the effect of T-cell exposure to exosomes expressing FasL demonstrated that apoptosis associated with CD3-zeta loss was, partially, FasL-dependent (Whitecar et al., *Am. J. Obstet. Gynecol.* 185:812-881, 2001).

Experiments were performed to investigate the differences in circulating exosomes in pregnant women delivering pre-term and in women delivering at term. The profiles of exosomal proteins in exosomes derived from these two groups were defined. In addition to providing circulating biomarkers to identify women destined to deliver pre-term, the proteins present in pre-term exosomes can provide insight into the mechanism of pre-term birth.

A nested, case-control pilot study was performed in a cohort of 3,992 women. All women who had previously given blood for routine genetic multiple marker screening and subsequently delivered at the University of North Carolina-Chapel Hill between January 2004 and November 2008 were eligible. All women, regardless of risk status or payer status, were offered this screening as part of routine prenatal care. Non-fasting blood samples were collected for routine genetic multiple marker screening between 15 and 20 weeks gestation, and serum aliquots were bar-coded and frozen at −70° C. Maternal demographic and medical data were chart abstracted. This study was approved by the institutional review board before data collection, and patient permission was obtained to use banked serum for research purposes. Pre-term delivery was defined as non-iatrogenic spontaneous pre-term delivery between 23 weeks, 0-7 days and 34 weeks, 0-7 days gestation. Healthy women with term deliveries (≥37 weeks gestation) were used as controls. In the present study, for both cases and controls, women with multiple gestation, major congenital fetal anomalies, pregestational hypertension, kidney disease, diabetes mellitus, known thrombophilias, or any other significant preexisting chronic medical disease were excluded. Two investigators reviewed all patient charts retrospectively, and only patients meeting the strict definitions described above were included in the study. For purposes of study design, the population was limited to women with serum collected between 15 and 17 weeks gestation.

From the total cohort, 21 cases were identified during the study period who met all inclusion and exclusion criteria. These cases were matched by age, race/ethnicity, and body mass index in 1:1 ratio, to a random, computer-generated referent group of 21 healthy women delivering at term. All patient samples were coded and patient data maintained separately. Demographic data were abstracted from the prenatal and inpatient records. The following data collected were also based on maternal self-report: pre-pregnancy weight, smoking, illicit substance use, and date of last menstrual period (LMP). Gestational age was determined from prenatal records. In cases of uncertain LMP, ultrasound determined gestational age was used. Maternal-fetal variables abstracted from chart review included: gestational age at delivery, clinical chorioamnionitis, birth weight, and activity, pulse, grimace, appearance, and respiration (APGAR) score.

Exosomes were isolated from all serum samples by a combination of chromatography and polyethylene glycol (PEG) precipitation. Initially, sera were centrifuged at 400×g for 10 minutes and the supernatant was at 10,000×g for 20 minutes. The supernatant was applied to a Sepharose 2B column (1.0 cm×15 cm) and the sample was fractionated isocratically with Tris-buffered saline. The elution was monitored by absorbance at 280 nm and the void volume fractions were collected and pooled. These preparations (~50 µg/ml) were examined by dynamic light scattering, using a Malvern 4700 autosizer (Malvern instruments Ltd., UK) with a 20 mW helium/neon laser (633 nm). Light scattering from the sample was detected by a photomultiplier tube placed at 90 degrees to the incident laser beam. The translational diffusion coefficient of the vesicular material was calculated from the time autocorrelation of the scattered light intensity and the translational diffusion coefficient was extracted from the correlogram using the method of cumulants, as applied in the proprietory Malvern software. The diameter of the exosomes was obtained from the application of Stokes-Einstein equations. This analysis demonstrated that the size distribution profile displayed a bell-shaped curve, indicating a homogeneous population with a mean diameter of 70.05±1.34 nm (FIG. 1).

The exosomes were pelleted from these fractions by precipitation with ExoQuick (SBI, Mountain View, Calif.). ExoQuick was added to the exosome-containing fractions at a 1:5 (v/v) dilution, incubated overnight, and pelleted by centrifugation at 10,000×g for 5 minutes. Pelleting of the exosomes was assessed by assaying protein concentrations in both the pellet and supernatant. The resulting pellet was then subjected to extraction with TRIZOL by the manufacturer's instructions, except that the isopropanol precipitation of RNA was extended to overnight at 4° C. The extraction procedure was continued for protein isolation.

Figure 2:
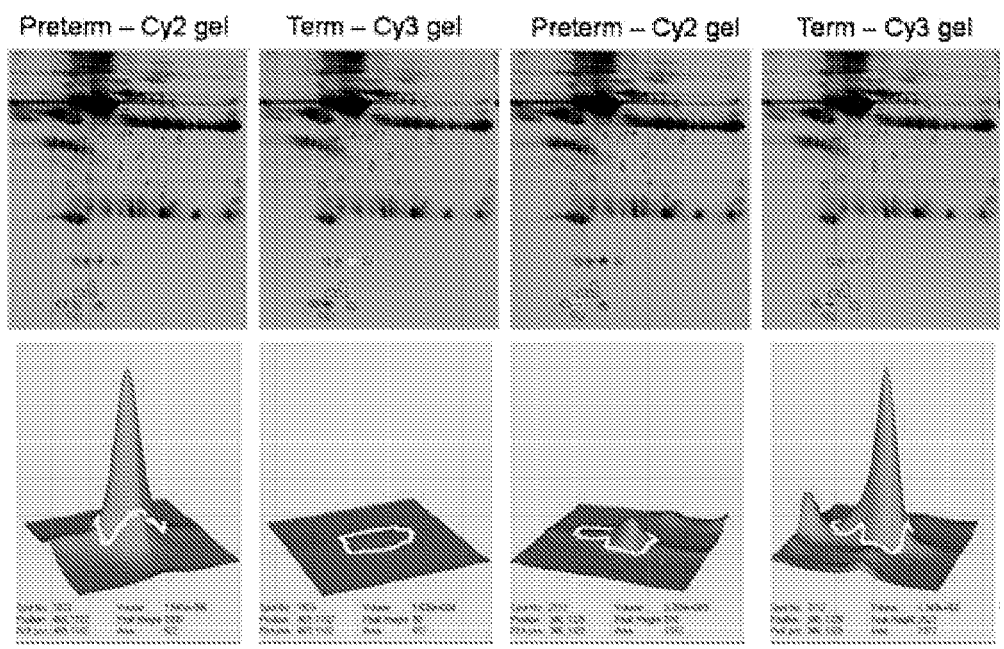
FIG. 2 shows four 2D-gels and four depictions of spot quantitation performed using DeCyder 2D software for two representative spots: one protein spot associated with exosomes from pre-term pregnancy-derived exosomes (two left columns) and one protein spot associated with exosomes from term pregnancy (two right columns). For DeCyder spot detection, initially the protein spots in the Cy2 image of pooled sample (internal standard) were detected, followed by application of similar spot boundaries to the Cy3 image within each gel. Spot quantification was performed by automatic normalization of spot volumes from the experimental group (Cy3) against the internal standard.

Exosomal protein fractions from the TRIZOL extraction were initially analyzed by 2D-difference gel electrophoresis (DIGE). Aliquots of the exosomal proteins from all term pregnancies were pooled as a single sample, as were aliquots of the exosomal proteins derived from all of the preterm exosomes. The pool of exosomal protein (100 µg) from patients delivering at term were labeled with Cy2 and the protein pool from patients delivering pre-term were labeled with Cy3. To identify proteins displaying differential expressions, 2D-DIGE analysis was performed. Labeled samples (100 µg each) were applied to immobilized pH gradient strips. After isoelectric focusing, the strips were incubated in equilibration buffer. The strips were placed on polyacrylamide gels, cast using low fluorescence glass plates. After electrophoretic separation, individual images of Cy2- and Cy3-labeled proteins were obtained using a Typhoon 94100 scanner with excitation/emission wavelengths of 480 nm/530 nm for Cy2 and 520 nm/590 nm for Cy3. To define proteins exhibiting differential expression, 2D-DIGE gels were evaluated with DeCyder 6.0 software using pair-wise comparisons (FIG. 2). Statistical analysis and gel-to-gel comparisons were performed with the Biological Variation Analysis module (GE Healthcare). Protein spots unique to pre-term or term deliveries were excised and processed for protein identification by tandem mass spectrometry (MS). The 2D-DIGE and mass spectrometry protein identifications were performed by Applied Biomics (Hayward, Calif.).

The exosomal proteins were also analyzed using linear ion trap mass spectrometry (LTQ, Thermo Electron Corp) at the University of Louisville's Core Proteomics Laboratory. Exosomal proteins (100 µg) from four patients delivering pre-term and from four matched patients delivering at term were each analyzed separately. The proteins from individual patients were digested using trypsin, eluted from the reverse phase (RP)-HPLC, and analyzed by light triggered and quenched (LTQ) measurement. All MS/MS samples were evaluated using Sequest (ThermoFinnigan, San Jose, Calif.). Sequest was set-up assuming trypsin digestion. The profiles for each sample were obtained and analyzed with Scaffold 2_06_02 (Proteosome Software Inc., Portland, Oreg.), which validated MS/MS-based protein identification. Protein identifications were accepted if they could be established at greater than 99.0% probability and contained at least 2 identified peptides. Only proteins identified with 2 or more peptides and an expected value of less than 0.05 were included, since these criteria produce a false discovery rate (FDR) of 0%. Protein probabilities were assigned by the Protein Prophet's algorithm for protein prediction.

Descriptive measures and correlations for maternal age, gestation age at delivery, maternal BMI, birth weight, and previous term deliveries were calculated as means and standard deviations for the study population and compared by the Student's t-test. The racial proportions for the two groups were defined using Fisher's Exact test. Proteins were analyzed in duplicate and subjected to Biological Variation Analysis (BVA) for comparison of the study populations. Gel images were matched between gels using the BVA software feature, which detects the consistency of differences between samples across all gels and applies statistics to define the level of confidence for each of the differences. The BVA software calculates the average ratio between the two groups and performs Student's t-test analysis between the two groups.

Figure 3:
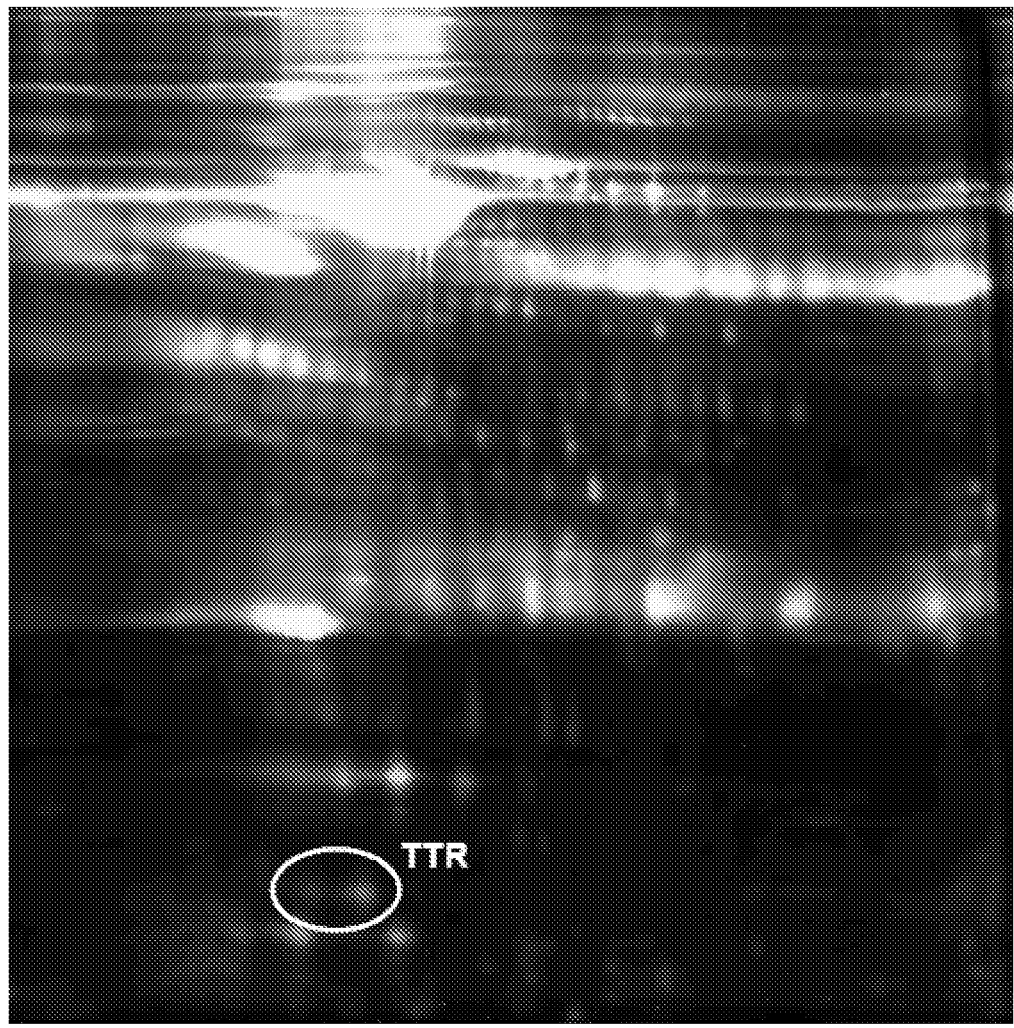
FIG. 3 is an image showing an overlap of a pair of 2D-polyacrylamide gels of proteins in circulating exosomes from (1) pregnant women subsequently delivering at term or (2) pregnant women subsequently delivering pre-term. Pooled exosomal proteins from patients delivering at term were labeled with Cy2 and pooled proteins from patients delivering pre-term were labeled with Cy3. 2D-polyacrylamide gel electrophoresis was performed to separate exosomal proteins by isoelectric focusing in the first dimension and by SDS-PAGE in the second dimension. The circled protein transthyretin (TTR) was identified by mass spectrometry, and was detected in exosomes from a pregnant woman subsequently delivering pre-term and not detected in exosomes from pregnant women subsequently delivering at term.

The proteomes of pregnancy-associated exosomes were initially analyzed based on migration patterns in 2D-DIGE. Exosomes from pregnancies delivering pre-term were labeled with Cy2 and exosomes from term delivering pregnancies were labeled with Cy3 (FIG. 3). Most of the separated protein spots had virtually identical migration patterns, in terms of molecular weight and isoelectric point. However, some spots appeared to be uniquely expressed in exosomes from term-delivering pregnancies and others were uniquely expressed in exosomes from pre-term delivering pregnancies. Of these proteins exhibiting primary expression in exosomes from term-delivering pregnancy, some were selected for mass spectrometric identification. Additional protein spots primarily were associated with pre-term-delivering pregnancies (e.g., see spot circled and identified in FIG. 3). For example, a protein associated with pre-term delivering pregnancies was identified as transthyretin (TTR).

To confirm and expand these proteomic analyses, the protein compositions of exosomes from four control patients (term birth) and four pre-term birth patients (pre-term) were evaluated by ion trap mass spectrometry. The linear ion trap fragmented peptides were used to obtain an MS/MS spectrum. The most abundant peak in the MS/MS mass spectrum was further isolated and fragmented to yield the MS3 spectrum. High mass accuracy, low background level, and additional peptide sequence information obtained from MS3 spectra yielded high-confidence protein identification. Peak list files obtained from fractions in each subset were merged and the peptide sequences were identified from their tandem mass spectra using the Sequest probability based search engine. Proteins identified using criteria corresponding to a level of false positives of p=0.0005. Based on the Sequest probability criteria, 669 proteins were identified. Of these, 402 proteins were present in circulating exosomes from both pre-term and term delivering pregnancies. One-hundred and fourteen proteins were unique to term delivering pregnancies and 153 proteins were unique to pre-term birth. The proteins identified by 2D-DIGE were also observed by ion trap MS, confirming their presence. The identities of these proteins were separated in biologic functions, biologic processes, and cellular location. The proteins GAS1, AFF3, fibronectin, TTR, RYR1, ZNF23, COL27A1, Kazrin isoform-1, KRTAP10-9, HTT, IGHG3, CYHR1, and XP_002348181 were detected in exosomes from women having a pre-term and cell compromise" network, there is a significant relationship between TNF-α and the identified pre-term exosomal proteins. Likewise, in the "cell mediated immune response" network, there is a focused relationship between insulin-like growth factor binding protein-1 and many of the identified pre-term exosomal proteins.

Exosomal protein composition exhibited substantial differential protein expressions based on pregnancy outcomes. The proteomic analyses of circulating exosomes in pregnant patients (both control and subject) revealed 669 proteins with high confidence. Most of these (402) were present in circulating exosomes from both pre-term and term delivering pregnancies. However, some exosomal proteins (114) were unique to term delivering pregnancies and others (153) were linked with exosomes from pregnancies ultimately delivering pre-term.

In addition to providing potential diagnostic biomarkers for preterm birth, the specific proteins associated with exosomes provide an insight into mechanisms underlying pre-term birth. It has been suggested that intrauterine inflammation may play a central role in preterm birth by up-regulating pro-inflammatory cytokines (Jacobsson et al., Acta Obstet. Gynecol. Scand. 82:423-431, 2003). This observation has led many investigators to propose a significant role for infections in preterm birth; however, the levels of IL-1β, IL-6, and TNF-α are elevated in amniotic fluid from women with pre-term birth, even in the absence of overt infections (Luo et al., Reprod. Sci. 17:532-539, 2010). TNF-α is a key target of the "organ injury and cell compromise" network influenced by pre-term-associated exosomal proteins.

TABLE 1

Protein Identification Probability from Ion Trap MS Data of Samples from Term (T) and Pre-Term (P-T) Pregnant Subjects.

| Protein | MW | T-1 | T-2 | T-3 | T-4 | P-T 1 | P-T 2 | P-T 3 | P-T 4 |
|---|---|---|---|---|---|---|---|---|---|
| GAS1 | 36 kD | ND[1] | ND | ND | ND | 84%[2] | 98% | 78% | 99% |
| AFF3 | 134 kD | ND | ND | ND | ND | 80% | 99% | 91% | 90% |
| Fibronectin | 263 kD | ND | ND | ND | ND | 100% | ND | 100% | 100% |
| TTR | 16 kD | ND | ND | ND | ND | 89% | 100% | ND | 90% |
| RYR1 | 565 kD | ND | ND | ND | ND | 100% | 90% | 91% | ND |
| ZNF23 | 73 kD | ND | ND | ND | ND | 98% | 87% | ND | 90% |
| COL27A1 | 188 kD | ND | ND | ND | ND | 89% | 100% | ND | 98% |
| Kazrin-1 | 86 kD | ND | ND | ND | ND | 89% | 90% | 91% | 100% |
| KRTAP10-9 | 30 kD | ND | ND | ND | ND | ND | 99% | 91% | 90% |
| HTT | 348 kD | ND | ND | ND | ND | 55% | 100% | ND | 100% |
| IGH3 | 57 kD | ND | ND | ND | ND | 93% | 100% | 91% | 100% |
| CYHR1 | 23 kD | ND | ND | ND | ND | 89% | ND | 100% | 83% |
| XP_002348181 | 33 kD | ND | ND | ND | ND | 89% | 100% | ND | 59% |
| ETV6 | 53 kD | ND | 99% | 91% | 90% | ND | ND | ND | ND |
| Claudin-10 | 24 kD | N/D | 58% | 99% | 91% | ND | ND | ND | ND |
| MAP9 | 74 kD | 91% | 90% | ND | 100% | ND | ND | ND | ND |
| CCDC13 | 81 kD | 91% | 100% | ND | 91% | ND | ND | ND | ND |
| HISPPD1 | 138 kD | ND | 90% | 99% | 91% | ND | ND | ND | ND |

[1]ND indicates a non-detectable level.
[2]The above protein identifications are based on a 1 peptide minimum.

birth, but were not detected in exosomes from women having a term birth (Table 1). Conversely, the proteins ETV6, claudin-10, MAP9, CCDC13, and HISPPD1 were detected in exosomes from women having term birth, but were not detected in exosomes from women having a pre-term birth (Table 1).

Using Ingenuity software, network pathway analyses were performed by combining proteins identified in the proteomic studies. Based on proteins unique to pre-term exosomes, the algorithms revealed 4 network pathways, the top two of which were described as "organ injury and cell compromise" and "cell mediated immune responses." In the "organ injury One marker for pre-term birth is fetal fibronectin. Fetal fibronectin is an extracellular glycoprotein found in high concentrations in the placenta and amniotic fluid, which is thought to act as the adhesive substance between the membranes and the uterine wall. Fetal fibronectin is detectable in about 4% of pregnant women after 20 gestational weeks, possibly reflecting transudation of amniotic fluid or disruption of the chorio-decidual interface (Mercer et al., Am. J. Obstet. Gynecol. 195:818-821, 2006). In eight studies examining fetal fibronectin, the sensitivity to predict pre-term birth before 34 weeks ranged from 21% to 94% (median 80%), whereas the positive predictive value (PPV) ranged from 12% to 79% (median 48%) (Leitich et al., *Am. J. Obstet. Gynecol.* 180:1169-1176, 1999). The sensitivity was higher at 50%-100% (median 86%) for birth within 7-10 days (17 studies) (Honest et al., BMJ325:301-311, 2002). Fetal fibronectin testing was insensitive with approximately 90% of those who did deliver pre-term having a negative test (less than 50 ng/mL) at 22-24 weeks (Vogel et al., *Acta Obstet. Gynecol. Scand.* 84:516-525, 2005). Due to this lack of sensitivity, studies have considered combining composite risk scores with fetal fibronectin and cervical length to improve sensitivity. However, combining composite risk score, corticotropin-releasing hormone (CRH), and fetal fibronectin in the general obstetric population only yielded a sensitivity of 54% and specificity of 87% (Sibai et al., *Am. J. Obstet. Gynecol.* 193: 1181-1186, 2005).

Further, IL-1β is considered to be a critical cytokine during inflammation. Fibronectin is highly expressed on exosomes derived from preterm pregnancies. Fibronectin has been shown to stimulate the expression of IL-1β mRNA and its translation into the 31 kD intracellular precursor, in addition to the secretion of the 17 kD active protein from monocytic cells (Roman et al., *Cytokine* 12:1581-1596, 2000). During pregnancy, inflammation is associated with decreased plasma levels of IGF-1 and increased levels of IGFBP-1 (Verhaeghe et al., *Am. J. Obstet. Gynecol.* 188:485-491, 2003). In pre-term birth, decreases in IGF-1 and IGFBP-3 are observed, together with an increase in IGFBP-1. This pre-term increase in IGFBP-1 has been linked with the induction of IL-6, IL-8, and TNF-α. This pro-inflammatory response and the alterations in the IGF system appear to be involved in the development of cerebral damage, which is commonly observed in preterm infants (Hansen-Pupp et al., *Acta Paediatrica* 96:830-836, 2007).

These data demonstrate two sets of potential biomarkers for the early (15-17 weeks gestation) identification of women destined to deliver preterm. The analyses of exosomal proteins provide easily assessed markers, obtained non-invasively, that accurately discriminate patients destined to deliver at term versus those destined to deliver pre-term at a time point when prophylactic therapies are effective. The differentially expressed exosomal components also support the role of a pro-inflammatory environment in the development of pre-term birth. This pro-inflammatory environment exists in the absence of overt infections and at least 12-22 weeks prior to the pre-term birth, suggesting pre-existing genetic regulation of preterm birth.

Example 2

Immunoblot Confirmation of the GAS1 Biomarker

Figure 4:
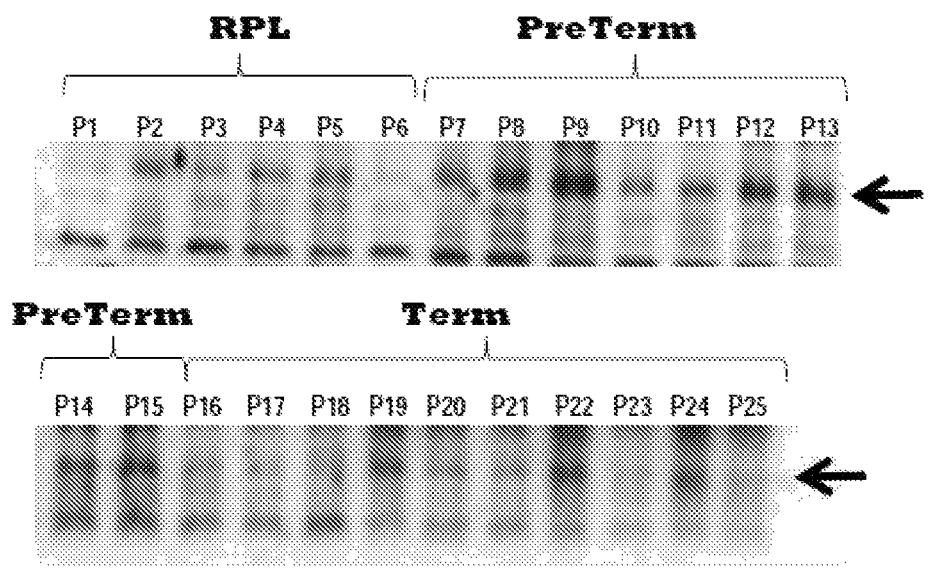
FIG. 4 is a pair of immunoblots of exosome samples from pregnant women having had recurrent pregnancy loss (RPL), pregnant women subsequently delivering pre-term (Pre-Term), and pregnant women subsequently delivering at term (Term). The immublots shown were developed using an anti-GAS1 antibody.

An additional set of immunoblot experiments was performed to confirm that GAS1 is a biomarker present in exosomes from pregnant women who subsequently deliver pre-term. In these experiments, exosomes from pregnant women subsequently delivering pre-term (Pre-Term) and pregnant women subsequently delivering at term (Term) were immunoblotted using an anti-GAS1 antibody. The resulting data show increased levels of GAS1 in exosomes from pregnant women subsequently delivering pre-term, as compared to the levels of GAS1 in exosomes from pregnant women delivering at term (FIG. 4).

OTHER EMBODIMENTS

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

SEQUENCE LISTING (80 sequences)

SEQ ID NO: 1 - DNA, 2844 bp, Homo sapiens
agcagccggcacggggacagccggccgcacaacggatctgcaggcgcggagcaaaatgcacccgccgcgccgcgcggtcctgcagccccgccacggccccgcggcccgcacccccccggggcgacagtgagcctctcccgccaccaccgggggccgagcggagggctctcgggtgggagagcgggaccagatctcgacagctgttcatttccaggaagccaccgcagccagagcgaaaggggaccttctgccaccagcggggcatcagccagcggcgcgcatggatttatgaagacactcatgcaagaagtgggcaggacttggacaaacttttccaccggctccgcgtccgccgctccccgcgcctcgtctcctttcccctcctctcccggcggccgccgctgcccgcgatggtggccgcgctgctgggcggcggcggcgaggcccgcggggggacagtgccgggcgcctggctgtgcctgatggcgctgctgcagctgctgggctcggcgccgcggggatcggggctggcgcacggccgccgcctcatctgctggcaggcgctgctgcagtgccagggggagccggagtgcagctacgcctacaaccagtacgccgaggcgtgcgcgccggtgctggcgcagcacggcgggggcgacgcgcccggggccgccgccgccgctttcccggcctcggccgcctctttctcgtcgcgctggcgctgcccgagtcactgcatctcggccctcattcagctcaaccacacgcgccgcgggcccgccctggaggactgtgactgcgcgcaggacgagaactgcaagtccaccaagcgcgccattgagccgtgcctgccccggacgagcggcggcggcgcgggcggccccggcgcgggcggggtcatgggctgcaccgaggcccggcggcgctgcgaccgcgacagccgctgcaacctggcgctgagccgctacctgacctactgcggcaaagtcttcaacgggctgcgctgcacggacgaatgccgcaccgtcattgaggacatgctggctatgcccaaggcggcgctgctcaacgactgcgtgtgcgacggcctcgagcggcccatctgcgagtcggtcaaggagaacatggcccgcctgtgcttcggcgccgagctgggcaacggccccggcagcagcggctcggacgggggcctggacgactactacgatgaggactacgatgacgagcagcgcaccgggggcgcgggtggtgagcagccgctggacgacgacgacggcgtcccgcacccaccgcgcccgggcagcggcgctgctgcatcgggcggccgcggggacctgccctatgggcctgggcgcaggagcagcggcggcggcggccgcttggcgccccggggcgcctggaccccactcgcctccatcttgctgctgctgcttgggccgctcttttagccctcgcgccccccgccgttggctgcgggagagcccgcgtcccactcccgtgctcgcctcgaccccgcgccgggcacctgtggcttgggacagatagaagggatggttggggatacttcccaaaactttttccaagtcaacttggtgtagccggttccccggccacgactctgggcacttcccctgaagctcctctccggagcttgacttcttggacctcctcccccgccccaattccaagctccagaaactcccaactcgtctgccgtccagaaagctagctgcagtgttcaggacgtccgggaggaagcaagcatgtgggggacagaacagtagtcctggactcgaaagggaaggtgctgaccagtggggccttagcaatttgaagggttgggaaggaggaattatatttgcaaaggggctgtctattagcatatttcctttgagggggcaaaaaaaagtgccagtatcgacttttacagattgtggccagtgaggatattataatcctatgtaaacagaaaagtcccacttaccgattcattctttcactgtttgtatctgcgcccagaattctcagtgacgtgggggtgagggtgggtggcgattgccttagagggaacccctaaattggttttggataagtttgagcccttgaccttaatttcattgctaccactctgatctcttagcacatttcttaggattaagggtccaaaaatgctgatctaaggggttgccatggtgttgaacaatgcaactttttatttaaaaaagctctgcactgccatgtatgaaagtctctttatgatgtttgtttttttgtcatttttgttctttacatcaagaaattttatgtttaaatatgcggagaatgtatattgcctctgctcctatcagggttgctaaaccctggtacatcgtatataaaatgtattaaaactggggtttgttaccagttgctgtactttgtatatagaatttttataaattgtatgcttcagaaataatttatttttaaaaagaaattaaaagttttaaactcacatccatattacacctttcccccctgaaatgtatagaatccatttgtcatcaggaatcaaaacccacagtccattgtgaagtgtgctatatttagaacagtcttaaaatgtacagtgtattttatagaattgaagttaacattcttattttcaagagaatttatggacgttgtagaaatgtacaaatgcatttccaaactgccttaaacgttgtatttttatagacatgttttttaaaaatcctaagtttttaaataactatggatttgtgtattttttttggttatttgttttattaaaacatgtacatcagtaaagagttttaaacaatgaaaaaaaaaaaaaaaaaa

SEQ ID NO: 2 - protein, 345 aa, Homo sapiens
MVAALLGGGGEARGGTVPGAWLCLMALLQLLGSAPRGSGLAHGRRLICWQALLQCQGEPECSYAYNQYAEACAPVLAQHGGGDAPGAAAAAFPASAASFSSRWRCPSHCISALIQLNHTRRGPALEDCDCAQDENCKSTKRAIEPCLPRTSGGGAGGPGAGGVMGCTEARRRCDRDSRCNLALSRYLTYCGKVFNGLRCTDECRTVIEDMLAMPKAALLNDCVCDGLERPICESVKENMARLCFGAELGNGPGSSGSDGGLDDYYDEDYDDEQRTGGAGGEQPLDDDDGVPHPPRPGSGAAASGGRGDLPYGPGRRSSGGGGRLAPRGAWTPLASILLLLLGPLF

SEQ ID NO: 3 - DNA, 8153 bp, Homo sapiens
cgccagcgagaagagagctccacgctcagcctcagaagaaagacgttcaacgacttactggggagagaaagaaaaggaacgggagctgagagctgatcacctgcctttccagaccggagacgggcggcaagtttgaagtcgacacccagaggccagtttgtcccccttcccgcgcgcgggcggcccgagcctcggcggcggcggtagcggcggcggcgacgctgacacctcccaccatggacagcttcgacttagccctgctccaggaatgggacctcgagtcactgtgtgtctatgaaccagatagaaatgcattacggaggaaagaacgagaaagaagaaatcaagaaactcaacaggatgatggcacgtttaattctagttactctctcttcagtgagccctacaagactaacaagggggatgaactctccaaccggatccagaacactttaggcaattatgatgaaatgaaagactttttaactgatagatccaatcagagtcatctcgttggagttcccaaacctggggttcctcagactcctgtgaacaagatcgatgaacattttgttgcagattcaagagcccagaaccagccctcgtctatctgtagcactacaacttccacaccagcagctgtccccgtgcagcagagtaagagaggcactatgggctggcagaaggctgggcacccaccctctgacggccaacagagagcaacacaacagggctctctcaggaccttgcttggagatggtgttggcagacagcagcctcgggccaaacaagtgtgcaatgtggaggtgggccttcagacccaggagaggccacctgccatggcggccaagcacagcagcagcggacactgtgttcagaactttcctccatccctagcttcaaaacccagcctggtccagcagaaaccgaccgcgtatgtgaggccaatggacggccaagatcaggcccctgatgagtctcctaagctgaagtcgtcttcggaaaccagcgtgcactgcacatcatacaggggagtccctgccagcaagccggagcctgccagagccaaggccaagctctccaagttcagcatccccaagcagggggaggagagtagatctggagaaaccaacagctgtgttgaagaaataatccgggagatgacctggcttccaccactttctgctattcaagcacctggcaaagtggaaccaaccaaatttccatttccaaataaggactctcagcttgtatcctctggacacaataatccaaagaaaggtgatgcagagccagagagtccagacaatggcacatcgaatacatcaatgctggaagatgaccttaagctaagcagtgatgaagaggagaatgaacagcaggcagctcagagaacggctctccgcgctctctctgacagcgccgtggtccagcagcccaactgcagaacctcggtgccttccagcaagggcagcagcagcagcagcagcagcggcagcagcagctcctccagcgactcagagagcagctccggatctgactcggagaccgagagcagctccagcgagagtgagggcagcaagcccccccacttctccagccccgaggctgaaccggcatcctctaacaagtggcagctggataaatggctaaacaaagttaatccccacaagcctcctattctgatccaaaatgaaagccacgggtcagagagcaatcagtactacaacccggtgaaagaggacgtccaggactgtgggaaagtccccgacgtttgccagcccagcctgagagagaaggagatcaagagcacttgcaaggaggagcaaaggccaaggacagccaacaaggcccctgggagtaaaggcgtgaagcagaagtccccgcccgcggccgtggccgtggcggtgagcgcagccgccccgccacccgcagtgccctgtgcgcccgcggagaacgcgcccgcgcctgcccggaggtccgcgggcaagaagcccaccaggcgcaccgagaggacctcagccggggacggcgccaactgccaccggcccgaggagcccgcggccgcggacgcgctggggacgagcgtggtggtccccccggagcccaccaaaaccaggccctgtggcaacaacagagcgagccaccgcaaggagctgcgctcctccgtgacctgcgagaagcgccgcacgcgggggctaagcaggatcgtccccaaatccaaggagttcattgagacagagtcgtcatcttcatcctcctcctcggactccgacctggagtccgagcaggaggagtaccctctgtccaaagcacagaccgtggctgcctctgcctcctccgggaatgatcagaggctgaaggaggccgctgccaacgggggcagtggtcctagggcccctgtaggctccatcaacgccaggaccaccagtgacatcgccaaggagctggaggagcagttctacacactggtcccctttggccggaacgaacttctctcccctctaaaggacagtgatgagatcaggtctctctgggtcaaaatcgacctgaccctcctgtccaggatcccagaacacctgccccaggagccaggggtattgagcgcccctgccaccaaggactctgagagcgcaccgcccagccacacctcggacacacctgcagaaaaggctttgccaaaatccaagaggaaacgcaagtgtgacaacgaagacgactacagggagatcaagaagtcccagggagagaaagacagctcttcaagactggccacctccaccagtaatactttgtctgcaaaccactgcaacatgaacatcaacagtgtggcaataccaataaataaaaatgaaaaaatgcttcggtcgcccatctcacccctctctgatgcatctaaacacaaatacaccagcgaggacttaacttcttccagccgacctaatggcaacagtttgtttacttcagcctcttccagcaaaaagcctaaggccgacagccagctgcagcctcacggcggagacctcacgaaagcagctcacaacaattctgaaaacattcccctccacaagtcacggccgcagacgaagccgtggtctccaggctccaacggccacagggactgcaagaggcagaaacttgtcttcgatgatatgcctcgcagtgccgattattttatgcaagaagctaaacgaatgaagcataaagcagatgcaatggtggaaaagtttggaaaggctttgaactatgctgaagcagcattgtcgtttatcgagtgtggaaatgcaatggaacaaggccccatggaatccaaatctccttatacgatgtattcagaaacagtagagctcatcaggtatgctatgagactaaaaacccactcaggccccaatgccacaccagaagacaaacaactggctgcattatgttaccgatgcctggccctcctgtactggcggatgtttcgactcaaaagggaccacgctgtaaagtattcaaaagcactaatcgactatttcaagaactcatctaaagccgcccaagccccatctccgtggggggccagtggaaagagcactggaaccccatcccccatgtctcccaacccctctcccgccagctccgtggggtctcagggcagcctctccaacgccagcgccctgtccccgtcgaccatcgtcagcatcccacagcgcatccaccagatggcggccaaccacgtcagcatcaccaacagcatcctgcacagctacgactactgggagatggccgacaacctggccaaggaaaaccgagaattcttcaacgacctggatctgctcatggggccggtcaccctgcacagcagcatggagcacctggtccagtactcccaacagggcctgcactggctgcggaacagcgcccacctgtcatagggacctcaccctggggccagagtgggctctggtctccacagatggctcaacgtttttggacactgtgctactgaaactcccagccacagcatttatcagactgcggtgaacatttcctcagcattgaacaatgatcttttgcagggcatgtgtgtttgtatgtgtgggtatataagaagccgcctgtgtatgtgtgtaagatacacagctcttcagaacacaccttctttgtctagtttccataatcccaggctagacaaagtgatcagaggtttctgactagaggaagtacacacacacacacacacacacacacacaccgtacactcacacacaatcacagacacacactttctattccattccagtgctaaaccgtgacttcttagaaaattcaaccaaaatctcatgggttagttaaccaggtgcaatacagcacaccaaaagcttgactgccagtgaagatggacctgctcttatactgttgattactttcagtattaatatactattccccaattattttttgattggtatgtattaatgggtaattgaataatgaaaataagccaggtatttttgtgccggaagtttactagattgcatgttaccaaataccctgctcttcctctaattcccttcccccatctgactctattatcaactaaatgcattccaggcaaacagatggacactcacagcccttcccagccccacctccaagtagtatgcaaatggcactgagatttagcaaaaacgcggcgtctttgaaagttaacagacactaaggtagcagtgcctgtgtgttggagctcagttaggagttgaagttttctgcacctgtgataacaagcccaccagccacatgcatttcttcttcctgccactgtgactcggtggctgtagagccacatggcatttgtcagccaatctgtttcaagtcttttctttccaccaatagctttcttacagattttcttggctaaatgaggccattacctagattgtcccttcagtaggagcctgaatccttcgcttaccaggctgagagctatttgccatgataatgctgattctctcactcctcatgcagaatgtgcacctgcagccctttgatgcgttttgatttgggggcgatttttcaggctttgattagcaggctgcttgcaatgcagaagatcacagttcctttctggggcagcagcaaccagagcctcttcctgtgtcctgtgtgtctggtatgtttacaccttgctctgagtttttctcttgttttctttttttaattaagtttacattttagtttctttgacatcttgtttacagtttttgtctgatgttttttcttttgtagtgtcttatgccctagatttagtcatcttgttaaatatatttggatatgaaatcttgacgaaaagaaaataactcctgaaaaagagggtctatcttgccacacgttaaaaacaaaaataatgtccttgtggcctcttacttgataaagttgcaccaggacggtctgagaaaggcaggcggtgtaatatgtggtgcaatccattttttcaaggtgatgacggcacaaaatacttagactagatgctgatccataaacattcactgatattcttacaggttggtttgcagtgttaacatttttgttagcctgatctgtaggtgggaagtaagatcatcataattccttagctctgagcactgattcaaaattgtataaatgactgaacaacttagatgatttgaaattaattgaaaataagaagggcttgtggaatttgcatttggctttggccttcaagcatttggaaatattaagagaatttccattttacatgtctccaactggggtgcttcttacaaccctttcactttttttttgagacgagtttcgctctgttgcccaggctggagtgcagtggcacgatctcggctcactgcatcctctgcctcctgggttcaagtgattgtcccgcctcagcctcccaagtagctgggattacaggtgtgcactaccatgcccagctaatttttgtgtttttagtagagactgggtttcaccatgttggccaggctcgtctcaaactcctgacctcaggtgatctacccgcctccacctcccaaagtgttgtgattacaggcgtgagccaccacacccagccctttcactaatttttggcagagttcacaatcccatcctatgtcagaaacttgaacctaacttaagaaattttgagtcatttttttggaggactgaggctttgttctacctactcttgaagaatcctgatgaaatattcaaacacataaagggatggccctggaggtctatcctgcatacctggagagcttctctggtcctgcccaccttgaaagttgcagactttgttgtaacatctatgtgatgagcttccctgtgaagccccatttgacaggtgggccagcagtgttttatcagcactctgatggcccacatttcccaggaaaacttcttgaaacttaccgttgtgggcagtggtcagagcgtgtagttcttatgactgtcttgtttcatctgtggagcacgtgtggagcacgttggtacagcagtttctgtggggtttggcatgggtgattttggttagtaaccatcctccaattgttgcttgtgaaagtcattcataacttgttccttttacttagttttgttgttactgctgttgttgttggtttggttggttttgagaccgggtctggctctgtagcccaagctggaatgcggtggcgcgatcatggctccctgcagcctcaaactcctgggctcaagcaatcctcctgcctcagcctcccaagcagctgggaagataggcacgtgccaccacacccggctaattttttctttattttttttgtagagatgggggtctcactatgttgcccaggctggtctcaaactcctgggctcaagcgatcctttggcctcggcctcccaaagtgcatgagccaccatgcctggcctgtttagttttgtttcaagttgaaatacctttcttgtgttttctaattagaaaagtaatatctactcattgtaaaaactcaaacagtgcagaaatgtagaaagtagaaagtgtaagtccctggttgtcccttctgcctgagacaaccactgctcacagtttgatgtatatccttccagagactctcaaatttaagcaaataatttttattaccatgtctttttatttgaagacgtacatttgcctccaaagttcaacacaagttcaactgaccatatccttccatgacctgaatagatgctatcctttatcacgatgttcaattgcctttgaaagagagtagtccaggtatattcctgatcaaaatttggcatttttgatgatactactctacacagatcagactcatgtgcagaatcgtgcctggagagagaggtttggttaagacagagatttctggaaacattcaaattgcaaatggaaacttgaaacccacaatctaatgaggaatgtactggaaaaataatctgaagagttgacaaattgtgtactagattgaacacatggaatgcaatgcaatgagactttctgcactaaaacttatcctcatatgtacaacaatgatgtgtgtattatataacagtgatgtgtacatttctgacaccccatacataatatacacagtttgtataaatgcatacatttaaaaatatatatgtacaatacagctaacataaaactgtagtacgcctgaaggatattactagtgcctaatattgagtatgagtcactgcgtgttcgcatcaacttggaagtgcagtaattgttataaaattaatcagtgcagccaacattatttatgaatcacatctttgaaactgtgcagtagcatatacatatatatttttaaataacatttttcacagttttccagagttactgttgaaatctgcatcaccaaaaaaaaaaaaaagcaagatttttttaacaatgtagacactcttcagacccagtaatctgcgtgtgatttcctatttgtagattcccaagagactttagcagtcaccagccttaatgcatgtacaggatattattgtgacttaatttatctgcagtttttaatccatgtgaaattggaatttataaacggacttggattaaacatgtctgcctttctaaggttgcaaatgttacattaaatgatttatgttgtaaaaaaaaaaaaaaaaaa

SEQ ID NO: 4 - protein, 1226 aa, Homo sapiens
MDSFDLALLQEWDLESLCVYEPDRNALRRKERERRNQETQQDDGTFNSSYSLFSEPYKTNKGDELSNRIQNTLGNYDEMKDFLTDRSNQSHLVGVPKPGVPQTPVNKIDEHFVADSRAQNQPSSICSTTTSTPAAVPVQQSKRGTMGWQKAGHPPSDGQQRATQQGSLRTLLGDGVGRQQPRAKQVCNVEVGLQTQERPPAMAAKHSSSGHCVQNFPPSLASKPSLVQQKPTAYVRPMDGQDQAPDESPKLKSSSETSVHCTSYRGVPASKPEPARAKAKLSKFSIPKQGEESRSGETNSCVEEIIREMTWLPPLSAIQAPGKVEPTKFPFPNKDSQLVSSGHNNPKKGDAEPESPDNGTSNTSMLEDDLKLSSDEEENEQQAAQRTALRALSDSAVVQQPNCRTSVPSSKGSSSSSSSGSSSSSSDSESSSGSDSETESSSSESEGSKPPHFSSPEAEPASSNKWQLDKWLNKVNPHKPPILIQNESHGSESNQYYNPVKEDVQDCGKVPDVCQPSLREKEIKSTCKEEQRPRTANKAPGSKGVKQKSPPAAVAVAVSAAAPPPAVPCAPAENAPAPARRSAGKKPTRRTERTSAGDGANCHRPEEPAAADALGTSVVVPPEPTKTRPCGNNRASHRKELRSSVTCEKRRTRGLSRIVPKSKEFIETESSSSSSSSDSDLESEQEEYPLSKAQTVAASASSGNDQRLKEAAANGGSGPRAPVGSINARTTSDIAKELEEQFYTLVPFGRNELLSPLKDSDEIRSLWVKIDLTLLSRIPEHLPQEPGVLSAPATKDSESAPPSHTSDTPAEKALPKSKRKRKCDNEDDYREIKKSQGEKDSSSRLATSTSNTLSANHCNMNINSVAIPINKNEKMLRSPISPLSDASKHKYTSEDLTSSSRPNGNSLFTSASSSKKPKADSQLQPHGGDLTKAAHNNSENIPLHKSRPQTKPWSPGSNGHRDCKRQKLVFDDMPRSADYFMQEAKRMKHKADAMVEKFGKALNYAEAALSFIECGNAMEQGPMESKSPYTMYSETVELIRYAMRLKTHSGPNATPEDKQLAALCYRCLALLYWRMFRLKRDHAVKYSKALIDYFKNSSKAAQAPSPWGASGKSTGTPSPMSPNPSPASSVGSQGSLSNASALSPSTIVSIPQRIHQMAANHVSITNSILHSYDYWEMADNLAKENREFFNDLDLLMGPVTLHSSMEHLVQYSQQGLHWLRNSAHLS

SEQ ID NO: 5 - DNA, 8136 bp, Homo sapiens
ctgatcacctgcctttccagaccggagacgggcggcaagtttgaagtcgacacccagaggccagtttgtcccccttcccgcgcgcgggcggcccgagcctcggcggcggcggtagcggcggcggcgacgctgacacctcccaccatggacagcttcgacttagccctgctccaggaatgggacctcgagtcactgtggggtgaagacatcttaaaccagaggaatgactctctagttgtggaatttcagtcatcagccagcagatgcaggagtgtctatgaaccagatagaaatgcattacggaggaaagaacgagaaagaagaaatcaagaaactcaacaggatgatggcacgtttaattctagttactctctcttcagtgagccctacaagactaacaagggggatgaactctccaaccggatccagaacactttaggcaattatgatgaaatgaaagactttttaactgatagatccaatcagagtcatctcgttggagttcccaaacctggggttcctcagactcctgtgaacaagatcgatgaacattttgttgcagattcaagagcccagaaccagccctcgtctatctgtagcactacaacttccacaccagcagctgtccccgtgcagcagagtaagagaggcactatgggctggcagaaggctgggcacccaccctctgacggccaacagagagcaacacaacagggctctctcaggaccttgcttggagatggtgttggcagacagcagcctcgggccaaacaagtgtgcaatgtggaggtgggccttcagacccaggagaggccacctgccatggcggccaagcacagcagcagcggacactgtgttcagaactttcctccatccctagcttcaaaacccagcctggtccagcagaaaccgaccgcgtatgtgaggccaatggacggccaagatcaggcccctgatgagtctcctaagctgaagtcgtcttcggaaaccagcgtgcactgcacatcatacaggggagtccctgccagcaagccggagcctgccagagccaaggccaagctctccaagttcagcatccccaagcagggggaggagagtagatctggagaaaccaacagctgtgttgaagaaataatccgggagatgacctggcttccaccactttctgctattcaagcacctggcaaagtggaaccaaccaaatttccatttccaaataaggactctcagcttgtatcctctggacacaataatccaaagaaaggtgatgcagagccagagagtccagacaatggcacatcgaatacatcaatgctggaagatgaccttaagctaagcagtgatgaagaggagaatgaacagcaggcagctcagagaacggctctccgcgctctctctgacagcgccgtggtccagcagcccaactgcagaacctcggtgccttccagcaagggcagcagcagcagcagcagcagcggcagcagcagctcctccagcgactcagagagcagctccggatctgactcggagaccgagagcagctccagcgagagtgagggcagcaagcccccccacttctccagccccgaggctgaaccggcatcctctaacaagtggcagctggataaatggctaaacaaagttaatccccacaagcctcctattctgatccaaaatgaaagccacgggtcagagagcaatcagtactacaacccggtgaaagaggacgtccaggactgtgggaaagtccccgacgtttgccagcccagcctgagagagaaggagatcaagagcacttgcaaggaggagcaaaggccaaggacagccaacaaggcccctgggagtaaaggcgtgaagcagaagtccccgcccgcggccgtggccgtggcggtgagcgcagccgccccgccacccgcagtgccctgtgcgcccgcggagaacgcgcccgcgcctgcccggaggtccgcgggcaagaagcccaccaggcgcaccgagaggacctcagccggggacggcgccaactgccaccggcccgaggagcccgcggccgcggacgcgctggggacgagcgtggtggtccccccggagcccaccaaaaccaggccctgtggcaacaacagagcgagccaccgcaaggagctgcgctcctccgtgacctgcgagaagcgccgcacgcgggggctaagcaggatcgtccccaaatccaaggagttcattgagacagagtcgtcatcttcatcctcctcctcggactccgacctggagtccgagcaggaggagtaccctctgtccaaagcacagaccgtggctgcctctgcctcctccgggaatgatcagaggctgaaggaggccgctgccaacgggggcagtggtcctagggcccctgtaggctccatcaacgccaggaccaccagtgacatcgccaaggagctggaggagcagttctacacactggtcccctttggccggaacgaacttctctcccctctaaaggacagtgatgagatcaggtctctctgggtcaaaatcgacctgaccctcctgtccaggatcccagaacacctgccccaggagccaggggtattgagcgcccctgccaccaaggactctgagagcgcaccgcccagccacacctcggacacacctgcagaaaaggctttgccaaaatccaagaggaaacgcaagtgtgacaacgaagacgactacagggagatcaagaagtcccagggagagaaagacagctcttcaagactggccacctccaccagtaatactttgtctgcaaaccactgcaacatgaacatcaacagtgtggcaataccaataaataaaaatgaaaaaatgcttcggtcgcccatctcacccctctctgatgcatctaaacacaaatacaccagcgaggacttaacttcttccagccgacctaatggcaacagtttgtttacttcagcctcttccagcaaaaagcctaaggccgacagccagctgcagcctcacggcggagacctcacgaaagcagctcacaacaattctgaaaacattcccctccacaagtcacggccgcagacgaagccgtggtctccaggctccaacggccacagggactgcaagaggcagaaacttgtcttcgatgatatgcctcgcagtgccgattattttatgcaagaagctaaacgaatgaagcataaagcagatgcaatggtggaaaagtttggaaaggctttgaactatgctgaagcagcattgtcgtttatcgagtgtggaaatgcaatggaacaaggccccatggaatccaaatctccttatacgatgtattcagaaacagtagagctcatcaggtatgctatgagactaaaaacccactcaggccccaatgccacaccagaagacaaacaactggctgcattatgttaccgatgcctggccctcctgtactggcggatgtttcgactcaaaagggaccacgctgtaaagtattcaaaagcactaatcgactatttcaagaactcatctaaagccgcccaagccccatctccgtggggggccagtggaaagagcactggaaccccatcccccatgtctcccaacccctctcccgccagctccgtggggtctcagggcagcctctccaacgccagcgccctgtccccgtcgaccatcgtcagcatcccacagcgcatccaccagatggcggccaaccacgtcagcatcaccaacagcatcctgcacagctacgactactgggagatggccgacaacctggccaaggaaaaccgagaattcttcaacgacctggatctgctcatggggccggtcaccctgcacagcagcatggagcacctggtccagtactcccaacagggcctgcactggctgcggaacagcgcccacctgtcatagggacctcaccctggggccagagtgggctctggtctccacagatggctcaacgtttttggacactgtgctactgaaactcccagccacagcatttatcagactgcggtgaacatttcctcagcattgaacaatgatcttttgcagggcatgtgtgtttgtatgtgtgggtatataagaagccgcctgtgtatgtgtgtaagatacacagctcttcagaacacaccttctttgtctagtttccataatcccaggctagacaaagtgatcagaggtttctgactagaggaagtacacacacacacacacacacacacacacaccgtacactcacacacaatcacagacacacactttctattccattccagtgctaaaccgtgacttcttagaaaattcaaccaaaatctcatgggttagttaaccaggtgcaatacagcacaccaaaagcttgactgccagtgaagatggacctgctcttatactgttgattactttcagtattaatatactattccccaattattttttgattggtatgtattaatgggtaattgaataatgaaaataagccaggtatttttgtgccggaagtttactagattgcatgttaccaaataccctgctcttcctctaattcccttcccccatctgactctattatcaactaaatgcattccaggcaaacagatggacactcacagcccttcccagccccacctccaagtagtatgcaaatggcactgagatttagcaaaaacgcggcgtctttgaaagttaacagacactaaggtagcagtgcctgtgtgttggagctcagttaggagttgaagttttctgcacctgtgataacaagcccaccagccacatgcatttcttcttcctgccactgtgactcggtggctgtagagccacatggcatttgtcagccaatctgtttcaagtcttttctttccaccaatagctttcttacagattttcttggctaaatgaggccattacctagattgtcccttcagtaggagcctgaatccttcgcttaccaggctgagagctatttgccatgataatgctgattctctcactcctcatgcagaatgtgcacctgcagccctttgatgcgttttgatttgggggcgatttttcaggctttgattagcaggctgcttgcaatgcagaagatcacagttcctttctggggcagcagcaaccagagcctcttcctgtgtcctgtgtgtctggtatgtttacaccttgctctgagtttttctcttgttttctttttttaattaagtttacattttagtttctttgacatcttgtttacagtttttgtctgatgttttttcttttgtagtgtcttatgccctagatttagtcatcttgttaaatatatttggatatgaaatcttgacgaaaagaaaataactcctgaaaaagagggtctatcttgccacacgttaaaaacaaaaataatgtccttgtggcctcttacttgataaagttgcaccaggacggtctgagaaaggcaggcggtgtaatatgtggtgcaatccattttttcaaggtgatgacggcacaaaatacttagactagatgctgatccataaacattcactgatattcttacaggttggtttgcagtgttaacatttttgttagcctgatctgtaggtgggaagtaagatcatcataattccttagctctgagcactgattcaaaattgtataaatgactgaacaacttagatgatttgaaattaattgaaaataagaagggcttgtggaatttgcatttggctttggccttcaagcatttggaaatattaagagaatttccattttacatgtctccaactggggtgcttcttacaaccctttcactttttttttgagacgagtttcgctctgttgcccaggctggagtgcagtggcacgatctcggctcactgcatcctctgcctcctgggttcaagtgattgtcccgcctcagcctcccaagtagctgggattacaggtgtgcactaccatgcccagctaatttttgtgtttttagtagagactgggtttcaccatgttggccaggctcgtctcaaactcctgacctcaggtgatctacccgcctccacctcccaaagtgttgtgattacaggcgtgagccaccacacccagccctttcactaatttttggcagagttcacaatcccatcctatgtcagaaacttgaacctaacttaagaaattttgagtcatttttttggaggactgaggctttgttctacctactcttgaagaatcctgatgaaatattcaaacacataaagggatggccctggaggtctatcctgcatacctggagagcttctctggtcctgcccaccttgaaagttgcagactttgttgtaacatctatgtgatgagcttccctgtgaagccccatttgacaggtgggccagcagtgttttatcagcactctgatggcccacatttcccaggaaaacttcttgaaacttaccgttgtgggcagtggtcagagcgtgtagttcttatgactgtcttgtttcatctgtggagcacgtgtggagcacgttggtacagcagtttctgtggggtttggcatgggtgattttggttagtaaccatcctccaattgttgcttgtgaaagtcattcataacttgttccttttacttagttttgttgttactgctgttgttgttggtttggttggttttgagaccgggtctggctctgtagcccaagctggaatgcggtggcgcgatcatggctccctgcagcctcaaactcctgggctcaagcaatcctcctgcctcagcctcccaagcagctgggaagataggcacgtgccaccacacccggctaattttttctttattttttttgtagagatgggggtctcactatgttgcccaggctggtctcaaactcctgggctcaagcgatcctttggcctcggcctcccaaagtgcatgagccaccatgcctggcctgtttagttttgtttcaagttgaaatacctttcttgtgttttctaattagaaaagtaatatctactcattgtaaaaactcaaacagtgcagaaatgtagaaagtagaaagtgtaagtccctggttgtcccttctgcctgagacaaccactgctcacagtttgatgtatatccttccagagactctcaaatttaagcaaataatttttattaccatgtctttttatttgaagacgtacatttgcctccaaagttcaacacaagttcaactgaccatatccttccatgacctgaatagatgctatcctttatcacgatgttcaattgcctttgaaagagagtagtccaggtatattcctgatcaaaatttggcatttttgatgatactactctacacagatcagactcatgtgcagaatcgtgcctggagagagaggtttggttaagacagagatttctggaaacattcaaattgcaaatggaaacttgaaacccacaatctaatgaggaatgtactggaaaaataatctgaagagttgacaaattgtgtactagattgaacacatggaatgcaatgcaatgagactttctgcactaaaacttatcctcatatgtacaacaatgatgtgtgtattatataacagtgatgtgtacatttctgacaccccatacataatatacacagtttgtataaatgcatacatttaaaaatatatatgtacaatacagctaacataaaactgtagtacgcctgaaggatattactagtgcctaatattgagtatgagtcactgcgtgttcgcatcaacttggaagtgcagtaattgttataaaattaatcagtgcagccaacattatttatgaatcacatctttgaaactgtgcagtagcatatacatatatatttttaaataacatttttcacagttttccagagttactgttgaaatctgcatcaccaaaaaaaaaaaaaagcaagatttttttaacaatgtagacactcttcagacccagtaatctgcgtgtgatttcctatttgtagattcccaagagactttagcagtcaccagccttaatgcatgtacaggatattattgtgacttaatttatctgcagtttttaatccatgtgaaattggaatttataaacggacttggattaaacatgtctgcctttctaaggttgcaaatgttacattaaatgatttatgttgtaaaaaaaaaaaaaaaaaa

SEQ ID NO: 6 - protein, 1251 aa, Homo sapiens
MDSFDLALLQEWDLESLWGEDILNQRNDSLVVEFQSSASRCRSVYEPDRNALRRKERERRNQETQQDDGTFNSSYSLFSEPYKTNKGDELSNRIQNTLGNYDEMKDFLTDRSNQSHLVGVPKPGVPQTPVNKIDEHFVADSRAQNQPSSICSTTTSTPAAVPVQQSKRGTMGWQKAGHPPSDGQQRATQQGSLRTLLGDGVGRQQPRAKQVCNVEVGLQTQERPPAMAAKHSSSGHCVQNFPPSLASKPSLVQQKPTAYVRPMDGQDQAPDESPKLKSSSETSVHCTSYRGVPASKPEPARAKAKLSKFSIPKQGEESRSGETNSCVEEIIREMTWLPPLSAIQAPGKVEPTKFPFPNKDSQLVSSGHNNPKKGDAEPESPDNGTSNTSMLEDDLKLSSDEEENEQQAAQRTALRALSDSAVVQQPNCRTSVPSSKGSSSSSSSGSSSSSSDSESSSGSDSETESSSSESEGSKPPHFSSPEAEPASSNKWQLDKWLNKVNPHKPPILIQNESHGSESNQYYNPVKEDVQDCGKVPDVCQPSLREKEIKSTCKEEQRPRTANKAPGSKGVKQKSPPAAVAVAVSAAAPPPAVPCAPAENAPAPARRSAGKKPTRRTERTSAGDGANCHRPEEPAAADALGTSVVVPPEPTKTRPCGNNRASHRKELRSSVTCEKRRTRGLSRIVPKSKEFIETESSSSSSSSDSDLESEQEEYPLSKAQTVAASASSGNDQRLKEAAANGGSGPRAPVGSINARTTSDIAKELEEQFYTLVPFGRNELLSPLKDSDEIRSLWVKIDLTLLSRIPEHLPQEPGVLSAPATKDSESAPPSHTSDTPAEKALPKSKRKRKCDNEDDYREIKKSQGEKDSSSRLATSTSNTLSANHCNMNINSVAIPINKNEKMLRSPISPLSDASKHKYTSEDLTSSSRPNGNSLFTSASSSKKPKADSQLQPHGGDLTKAAHNNSENIPLHKSRPQTKPWSPGSNGHRDCKRQKLVFDDMPRSADYFMQEAKRMKHKADAMVEKFGKALNYAEAALSFIECGNAMEQGPMESKSPYTMYSETVELIRYAMRLKTHSGPNATPEDKQLAALCYRCLALLYWRMFRLKRDHAVKYSKALIDYFKNSSKAAQAPSPWGASGKSTGTPSPMSPNPSPASSVGSQGSLSNASALSPSTIVSIPQRIHQMAANHVSITNSILHSYDYWEMADNLAKENREFFNDLDLLMGPVTLHSSMEHLVQYSQQGLHWLRNSAHLS

SEQ ID NO: 7 - DNA, 2005 bp, Homo sapiens
ccacgcgtccggaaagaaaaggaacgggagctgagagctgatcacctgcctttccagaccggagacgggcggcaagtttgaagtcgacacccagaggccagtttgtcccccttcccgcgcgcgggcggcccgagcctcggcggcggcggtagcggcggcggcgacgctgacacctcccaccatggacagcttcgacttagccctgctccaggaatgggacctcgagtcactgtgtgtctatgaaccagatagaaatgcattacggaggaaagaacgagaaagaagaaatcaagaaactcaacaggatgatggcacgtttaattctagttactctctcttcagtgagccctacaagactaacaagggggatgaactctccaaccggatccagaacactttaggcaattatgatgaaatgaaagactttttaactgatagatccaatcagagtcatctcgttggagttcccaaacctggggttcctcagactcctgtgaacaagatcgatgaacattttgttgcagattcaagagcccagaaccagccctcgtctatctgtagcactacaacttccacaccagcagctgtccccgtgcagcagagtaagagaggcactatgggctggcagaaggctgggcacccaccctctgacggccaacagagagcaacacaacagggctctctcaggaccttgcttggagatggtgttggcagacagcagcctcgggccaaacaagtgtgcaatgtggaggtgggccttcagacccaggagaggccacctgccatggcggccaagcacagcagcagcggacactgtgttcagaactttcctccatccctagcttcaaaacccagcctggtccagcagaaaccgaccgcgtatgtgaggccaatggacggccaagatcaggcccctgatgagtctcctaagctgaagtcgtcttcggaaaccagcgtgcactgcacatcatacaggggagtccctgccagcaagccggagcctgccagagccaaggccaagctctccaagttcagcatccccaagcagggggaggagagtagatctggagaaaccaacagctgtgttgaagaaataatccgggagatgacctggcttccaccactttctgctattcaagcacctggcaaagtggaaccaaccaaatttccatttccaaataaggactctcagcttgtatcctctggacacaataatccaaagaaaggtgatgcagagccagagagtccagacaatggcacatcgaatacatcaatgctggaagatgaccttaagctaagcagtgatgaagaggagaatgaacagcaggcagctcagagaacggctctccgcgctctctctgacagcgccgtggtccagcagcccaactgcagaacctcggtgccttccagcaagggcagcagcagcagcagcagcagcggcagcagcagctcctccagcgactcagagagcagctccggatctgactcggagaccgagagcagctccagcgagagtgagggcagcaagcccccccacttctccagccccgaggctgaaccggcatcctctaacaagtggcagctggataaatggctaaacaaagttaatccccacaagcctcctattctgatccaaaatgaaagccacgggtcagagagcaatcagtactacaacccggtgaaagaggacgtccaggactgtgggaaagtccccgacgtttgccagcccagcctgagagagaaggagatcaagagcacttgcaaggaggagcaaaggccaaggacagccaacaaggcccctgggagtaaaggcgtgaagcagaagtccccgcccgcggccgtggccgtggcggtgagcgcagccgccccgccacccgcagtgccctgtgcgcccgcggagaacgcgcccgcgcctgcccggaggtccgcgggcaagaagcccaccaggcgcaccgagaggacctcagccggggacggcgccaactgccaccggcccgaggagccc

SEQ ID NO: 8 - protein, 608 aa, Homo sapiens
MDSFDLALLQEWDLESLCVYEPDRNALRRKERERRNQETQQDDGTFNSSYSLFSEPYKTNKGDELSNRIQNTLGNYDEMKDFLTDRSNQSHLVGVPKPGVPQTPVNKIDEHFVADSRAQNQPSSICSTTTSTPAAVPVQQSKRGTMGWQKAGHPPSDGQQRATQQGSLRTLLGDGVGRQQPRAKQVCNVEVGLQTQERPPAMAAKHSSSGHCVQNFPPSLASKPSLVQQKPTAYVRPMDGQDQAPDESPKLKSSSETSVHCTSYRGVPASKPEPARAKAKLSKFSIPKQGEESRSGETNSCVEEIIREMTWLPPLSAIQAPGKVEPTKFPFPNKDSQLVSSGHNNPKKGDAEPESPDNGTSNTSMLEDDLKLSSDEEENEQQAAQRTALRALSDSAVVQQPNCRTSVPSSKGSSSSSSSGSSSSSSDSESSSGSDSETESSSSESEGSKPPHFSSPEAEPASSNKWQLDKWLNKVNPHKPPILIQNESHGSESNQYYNPVKEDVQDCGKVPDVCQPSLREKEIKSTCKEEQRPRTANKAPGSKGVKQKSPPAAVAVAVSAAAPPPAVPCAPAENAPAPARRSAGKKPTRRTERTSAGDGANCHRPEEP

SEQ ID NO: 9 - DNA, 3742 bp, Homo sapiens
gacgctgacacctcccaccatggacagcttcgacttagccctgctccaggaatgggacctcgagtcactgtgtgtctatgaaccagatagaaatgcattacggaggaaagaacgagaaagaagaaatcaagaaactcaacaggatgatggcacgtttaattctagttactctctcttcagtgagccctacaagactaacaagggggatgaactctccaaccggatccagaacactttaggcaattatgatgaaatgaaagactttttaactgatagatccaatcagagtcatctcgttggagttcccaaacctggggttcctcagactcctgtgaacaagatcgatgaacattttgttgcagattcaagagcccagaaccagccctcgtctatctgtagcactacaacttccacaccagcagctgtccccgtgcagcagagtaagagaggcactatgggctggcagaaggctgggcacccaccctctgacggccaacagagagcaacacaacagggctctctcaggaccttgcttggagatggtgttggcagacagcagcctcgggccaaacaagtgtgcaatgtggaggtgggccttcagacccaggagaggccacctgccatggcggccaagcacagcagcagcggacactgtgttcagaactttcctccatccctagcttcaaaacccagcctggtccagcagaaaccgaccgcgtatgtgaggccaatggacggccaagatcaggcccctgatgagtctcctaagctgaagtcgtcttcggaaaccagcgtgcactgcacatcatacaggggagtccctgccagcaagccggagcctgccagagccaaggccaagctctccaagttcagcatccccaagcagggggaggagagtagatctggagaaaccaacagctgtgttgaagaaataatccgggagatgacctggcttccaccactttctgctattcaagcacctggcaaagtggaaccaaccaaatttccatttccaaataaggactctcagcttgtatcctctggacacaataatccaaagaaaggtgatgcagagccagagagtccagacaatggcacatcgaatacatcaatgctggaagatgaccttaagctaagcagtgatgaagaggagaatgaacagcaggcagctcagagaacggctctccgcgctctctctgacagcgccgtggtccagcagcccaactgcagaacctcggtgccttccagcaagggcagcagcagcagcagcagcagcggcagcagcagctcctccagcgactcagagagcagctccggatctgactcggagaccgagagcagctccagcgagagtgagggcagcaagcccccccacttctccagccccgaggctgaaccggcatcctctaacaagtggcagctggataaatggctaaacaaagttaatccccacaagcctcctattctgatccaaaatgaaagccacgggtcagagagcaatcagtactacaacccggtgaaagaggacgtccaggactgtgggaaagtccccgacgtttgccagcccagcctgagagagaaggagatcaagagcacttgcaaggaggagcaaaggccaaggacagccaacaaggcccctgggagtaaaggcgtgaagcagaagtccccgcccgcggccgtggccgtggcggtgagcgcagccgccccgccacccgcagtgccctgtgcgcccgcggagaacgcgcccgcgcctgcccggaggtccgcgggcaagaagcccaccaggcgcaccgagaggacctcagccggggacggcgccaactgccaccggcccgaggagcccgcggccgcggacgcgctggggacgagcgtggtggtccccccggagcccaccaaaaccaggccctgtggcaacaacagagcgagccaccgcaaggagctgcgctcctccgtgacctgcgagaagcgccgcacgcgggggctaagcaggatcgtccccaaatccaaggagttcattgagacagagtcgtcatcttcatcctcctcctcggactccgacctggagtccgagcaggaggagtaccctctgtccaaagcacagaccgtggctgcctctgcctcctccgggaatgatcagaggctgaaggaggccgctgccaacgggggcagtggtcctagggcccctgtaggctccatcaacgccaggaccaccagtgacatcgccaaggagctggaggagcagttctacacactggtcccctttggccggaacgaacttctctcccctctaaaggacagtgatgagatcaggtctctctgggtcaaaatcgacctgaccctcctgtccaggatcccagaacacctgccccaggagccaggggtattgagcgcccctgccaccaaggactctgagagcgcaccgcccagccacacctcggacacacctgcagaaaaggctttgccaaaatccaagaggaaacgcaagtgtgacaacgaagacgactacagggagatcaagaagtcccagggagagaaagacagctcttcaagactggccacctccaccagtaatactttgtctgcaaaccactgcaacatgaacatcaacagtgtggcaataccaataaataaaaatgaaaaaatgcttcggtcgcccatctcacccctctctgatgcatctaaacacaaatacaccagcgaggacttaacttcttccagccgacctaatggcaacagtttgtttacttcagcctcttccagcaaaaagcctaaggccgacagccagctgcagcctcacggcggagacctcacgaaagcagctcacaacaattctgaaaacattcccctccacaagtcacggccgcagacgaagccgtggtctccaggctccaacggccacagggactgcaagaggcagaaacttgtcttcgatgatatgcctcgcagtgccgattattttatgcaagaagctaaacgaatgaagcataaagcagatgcaatggtggaaaagtttggaaaggctttgaactatgctgaagcagcattgtcgtttatcgagtgtggaaatgcaatggaacaaggccccatggaatccaaatctccttatacgatgtattcagaaacagtagagctcatcaggtatgctatgagactaaaaacccactcaggccccaatgccacaccagaagacaaacaactggctgcattatgttaccgatgcctggccctcctgtactggcggatgtttcgactcaaaagggaccacgctgtaaagtattcaaaagcactaatcgactatttcaagaactcatctaaagccgcccaagccccatctccgtggggggccagtggaaagagcactggaaccccatcccccatgtctcccaacccctctcccgccagctccgtggggtctcagggcagcctctccaacgccagcgccctgtccccgtcgaccatcgtcagcatcccacagcgcatccaccagatggcggccaaccacgtcagcatcaccaacagcatcctgcacagctacgactactgggagatggccgacaacctggccaaggaaaaccgagaattcttcaacgacctggatctgctcatggggccggtcaccctgcacagcagcatggagcacctggtccagtactcccaacagggcctgcactggctgcggaacagcgcccacctgtcatagggacctcaccctggggccagagtgggctctggtctccacaga

SEQ ID NO: 10 - protein, 1226 aa, Homo sapiens; identical to SEQ ID NO: 4

SEQ ID NO: 11 - DNA, 3817 bp, Homo sapiens
gacgctgacacctcccaccatggacagcttcgacttagccctgctccaggaatgggacctcgagtcactgtggggtgaagacatcttaaaccagaggaatgactctctagttgtggaatttcagtcatcagccagcagatgcaggagtgtctatgaaccagatagaaatgcattacggaggaaagaacgagaaagaagaaatcaagaaactcaacaggatgatggcacgtttaattctagttactctctcttcagtgagccctacaagactaacaagggggatgaactctccaaccggatccagaacactttaggcaattatgatgaaatgaaagactttttaactgatagatccaatcagagtcatctcgttggagttcccaaacctggggttcctcagactcctgtgaacaagatcgatgaacattttgttgcagattcaagagcccagaaccagccctcgtctatctgtagcactacaacttccacaccagcagctgtccccgtgcagcagagtaagagaggcactatgggctggcagaaggctgggcacccaccctctgacggccaacagagagcaacacaacagggctctctcaggaccttgcttggagatggtgttggcagacagcagcctcgggccaaacaagtgtgcaatgtggaggtgggccttcagacccaggagaggccacctgccatggcggccaagcacagcagcagcggacactgtgttcagaactttcctccatccctagcttcaaaacccagcctggtccagcagaaaccgaccgcgtatgtgaggccaatggacggccaagatcaggcccctgatgagtctcctaagctgaagtcgtcttcggaaaccagcgtgcactgcacatcatacaggggagtccctgccagcaagccggagcctgccagagccaaggccaagctctccaagttcagcatccccaagcagggggaggagagtagatctggagaaaccaacagctgtgttgaagaaataatccgggagatgacctggcttccaccactttctgctattcaagcacctggcaaagtggaaccaaccaaatttccatttccaaataaggactctcagcttgtatcctctggacacaataatccaaagaaaggtgatgcagagccagagagtccagacaatggcacatcgaatacatcaatgctggaagatgaccttaagctaagcagtgatgaagaggagaatgaacagcaggcagctcagagaacggctctccgcgctctctctgacagcgccgtggtccagcagcccaactgcagaacctcggtgccttccagcaagggcagcagcagcagcagcagcagcggcagcagcagctcctccagcgactcagagagcagctccggatctgactcggagaccgagagcagctccagcgagagtgagggcagcaagcccccccacttctccagccccgaggctgaaccggcatcctctaacaagtggcagctggataaatggctaaacaaagttaatccccacaagcctcctattctgatccaaaatgaaagccacgggtcagagagcaatcagtactacaacccggtgaaagaggacgtccaggactgtgggaaagtccccgacgtttgccagcccagcctgagagagaaggagatcaagagcacttgcaaggaggagcaaaggccaaggacagccaacaaggcccctgggagtaaaggcgtgaagcagaagtccccgcccgcggccgtggccgtggcggtgagcgcagccgccccgccacccgcagtgccctgtgcgcccgcggagaacgcgcccgcgcctgcccggaggtccgcgggcaagaagcccaccaggcgcaccgagaggacctcagccggggacggcgccaactgccaccggcccgaggagcccgcggccgcggacgcgctggggacgagcgtggtggtccccccggagcccaccaaaaccaggccctgtggcaacaacagagcgagccaccgcaaggagctgcgctcctccgtgacctgcgagaagcgccgcacgcgggggctaagcaggatcgtccccaaatccaaggagttcattgagacagagtcgtcatcttcatcctcctcctcggactccgacctggagtccgagcaggaggagtaccctctgtccaaagcacagaccgtggctgcctctgcctcctccgggaatgatcagaggctgaaggaggccgctgccaacgggggcagtggtcctagggcccctgtaggctccatcaacgccaggaccaccagtgacatcgccaaggagctggaggagcagttctacacactggtcccctttggccggaacgaacttctctcccctctaaaggacagtgatgagatcaggtctctctgggtcaaaatcgacctgaccctcctgtccaggatcccagaacacctgccccaggagccaggggtattgagcgcccctgccaccaaggactctgagagcgcaccgcccagccacacctcggacacacctgcagaaaaggctttgccaaaatccaagaggaaacgcaagtgtgacaacgaagacgactacagggagatcaagaagtcccagggagagaaagacagctcttcaagactggccacctccaccagtaatactttgtctgcaaaccactgcaacatgaacatcaacagtgtggcaataccaataaataaaaatgaaaaaatgcttcggtcgcccatctcacccctctctgatgcatctaaacacaaatacaccagcgaggacttaacttcttccagccgacctaatggcaacagtttgtttacttcagcctcttccagcaaaaagcctaaggccgacagccagctgcagcctcacggcggagacctcacgaaagcagctcacaacaattctgaaaacattcccctccacaagtcacggccgcagacgaagccgtggtctccaggctccaacggccacagggactgcaagaggcagaaacttgtcttcgatgatatgcctcgcagtgccgattattttatgcaagaagctaaacgaatgaagcataaagcagatgcaatggtggaaaagtttggaaaggctttgaactatgctgaagcagcattgtcgtttatcgagtgtggaaatgcaatggaacaaggccccatggaatccaaatctccttatacgatgtattcagaaacagtagagctcatcaggtatgctatgagactaaaaacccactcaggccccaatgccacaccagaagacaaacaactggctgcattatgttaccgatgcctggccctcctgtactggcggatgtttcgactcaaaagggaccacgctgtaaagtattcaaaagcactaatcgactatttcaagaactcatctaaagccgcccaagccccatctccgtggggggccagtggaaagagcactggaaccccatcccccatgtctcccaacccctctcccgccagctccgtggggtctcagggcagcctctccaacgccagcgccctgtccccgtcgaccatcgtcagcatcccacagcgcatccaccagatggcggccaaccacgtcagcatcaccaacagcatcctgcacagctacgactactgggagatggccgacaacctggccaaggaaaaccgagaattcttcaacgacctggatctgctcatggggccggtcaccctgcacagcagcatggagcacctggtccagtactcccaacagggcctgcactggctgcggaacagcgcccacctgtcatagggacctcaccctggggccagagtgggctctggtctccacaga

SEQ ID NO: 12 - protein, 1251 aa, Homo sapiens; identical to SEQ ID NO: 6

SEQ ID NO: 13 - DNA, 8815 bp, Homo sapiens
gcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacccgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagaggtgccccaactcactgacctaagctttgttgatataaccgattcaagcatcggcctgaggtggaccccgctaaactcttccaccattattgggtaccgcatcacagtagttgcggcaggagaaggtatccctatttttgaagattttgtggactcctcagtaggatactacacagtcacagggctggagccgggcattgactatgatatcagcgttatcactctcattaatggcggcgagagtgcccctactacactgacacaacaaacggctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggtgaggaaatccaaattggtcacatccccagggaagatgtagactatcacctgtacccacacggtccgggactcaatccaaatgcctctacaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagctttacactttctgctttaatagatttaagtggaccccaatatttattaaaattgctagtttaccgttcagaagtataatagaaataatctttagttgctcttttctaaccattgtaattcttcccttcttccctccacctttccttcattgaataaacctctgttcaaagagattgcctgcaagggaaataaaaatgactaagatattaaaaaaaaaaaaaaaaaa

SEQ ID NO: 14 - protein, 2477 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDPTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPEVPQLTDLSFVDITDSSIGLRWTPLNSSTIIGYRITVVAAGEGIPIFEDFVDSSVGYYTVTGLEPGIDYDISVITLINGGESAPTTLTQQTAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGEEIQIGHIPREDVDYHLYPHGPGLNPNASTGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 15 - DNA, 8647 bp, Homo sapiens
gcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacccgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagaggtgccccaactcactgacctaagctttgttgatataaccgattcaagcatcggcctgaggtggaccccgctaaactcttccaccattattgggtaccgcatcacagtagttgcggcaggagaaggtatccctatttttgaagattttgtggactcctcagtaggatactacacagtcacagggctggagccgggcattgactatgatatcagcgttatcactctcattaatggcggcgagagtgcccctactacactgacacaacaaacggctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagctttacactttctgctttaatagatttaagtggaccccaatatttattaaaattgctagtttaccgttcagaagtataatagaaataatctttagttgctcttttctaaccattgtaattcttcccttcttccctccacctttccttcattgaataaacctctgttcaaagagattgcctgcaagggaaataaaaatgactaagatattaaaaaaaaaaaaaaaaaa

SEQ ID NO: 16 - protein, 2421 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDPTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPEVPQLTDLSFVDITDSSIGLRWTPLNSSTIIGYRITVVAAGEGIPIFEDFVDSSVGYYTVTGLEPGIDYDISVITLINGGESAPTTLTQQTAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTVQKTPFVTHPGYDTGNGIQLPGTSGQQPSVGQQMIFEEHGFRRTTPPTTATPIRHRPRPYPPNVGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 17 - DNA, 8449 bp, Homo sapiens
gcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacccgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagctttacactttctgctttaatagatttaagtggaccccaatatttattaaaattgctagtttaccgttcagaagtataatagaaataatctttagttgctcttttctaaccattgtaattcttcccttcttccctccacctttccttcattgaataaacctctgttcaaagagattgcctgcaagggaaataaaaatgactaagatattaaaaaaaaaaaaaaaaaa

SEQ ID NO: 18 - protein, 2355 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDPTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 19 - DNA, 8374 bp, Homo sapiens
gcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacccgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagctttacactttctgctttaatagatttaagtggaccccaatatttattaaaattgctagtttaccgttcagaagtataatagaaataatctttagttgctcttttctaaccattgtaattcttcccttcttccctccacctttccttcattgaataaacctctgttcaaagagattgcctgcaagggaaataaaaatgactaagatattaaaaaaaaaaaaaaaaaa

SEQ ID NO: 20 - protein, 2330 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDPTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTVQKTPFVTHPGYDTGNGIQLPGTSGQQPSVGQQMIFEEHGFRRTTPPTTATPIRHRPRPYPPNVGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 21 - DNA, 8272 bp, Homo sapiens
gcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacccgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccactattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggtgaggaaatccaaattggtcacatccccagggaagatgtagactatcacctgtacccacacggtccgggactcaatccaaatgcctctacaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagctttacactttctgctttaatagatttaagtggaccccaatatttattaaaattgctagtttaccgttcagaagtataatagaaataatctttagttgctcttttctaaccattgtaattcttcccttcttccctccacctttccttcattgaataaacctctgttcaaagagattgcctgcaagggaaataaaaatgactaagatattaaaaaaaaaaaaaaaaaa

SEQ ID NO: 22 - protein, 2296 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDPTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTTIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGEEIQIGHIPREDVDYHLYPHGPGLNPNASTGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 23 - DNA, 7912 bp, Homo sapiens
gcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacccgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccactattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagctttacactttctgctttaatagatttaagtggaccccaatatttattaaaattgctagtttaccgttcagaagtataatagaaataatctttagttgctcttttctaaccattgtaattcttcccttcttccctccacctttccttcattgaataaacctctgttcaaagagattgcctgcaagggaaataaaaatgactaagatattaaaaaaaaaaaaaaaaaa

SEQ ID NO: 24 - protein, 2176 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDPTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTTIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 25 - DNA, 2402 bp, Homo sapiens
gcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctgtgagtatcccacccagaaaccttggatactgagtctcctaatcttatcaattctgatggtttctttttttcccagcttttgagccaacaactctgattaactattcctatagcatttactatatttgtttagtgaacaaacaatatgtggtcaattaaattgacttgtagactgaaaaaaaaaaaaaaaaaaaa

SEQ ID NO: 26 - protein, 657 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPVSIPPRNLGY

SEQ ID NO: 27 - DNA, 938 bp, Homo sapiens
gttgactaagtcaataatcagaatcagcaggtttgcagtcagattggcagggataagcagcctagctcaggagaagtgagtataaaagccccaggctgggagcagccatcacagaagtccactcattcttggcaggatggcttctcatcgtctgctcctcctctgccttgctggactggtatttgtgtctgaggctggccctacgggcaccggtgaatccaagtgtcctctgatggtcaaagttctagatgctgtccgaggcagtcctgccatcaatgtggccgtgcatgtgttcagaaaggctgctgatgacacctgggagccatttgcctctgggaaaaccagtgagtctggagagctgcatgggctcacaactgaggaggaatttgtagaagggatatacaaagtggaaatagacaccaaatcttactggaaggcacttggcatctccccattccatgagcatgcagaggtggtattcacagccaacgactccggcccccgccgctacaccattgccgccctgctgagcccctactcctattccaccacggctgtcgtcaccaatcccaaggaatgagggacttctcctccagtggacctgaaggacgagggatgggatttcatgtaaccaagagtattccatttttactaaagcagtgttttcacctcatatgctatgttagaagtccaggcagagacaataaaacattcctgtgaaaggcacttttcattccactttaacttgattttttaaattcccttattgtcccttccaaaaaaaagagaatcaaaattttacaaagaatcaaaggaattctagaaagtatctgggcagaacgctaggagagatccaaatttccattgtcttgcaagcaaagcacgtattaaatatgatctgcagccattaaaaagacacattctgtaaaaaaaaaaaa

SEQ ID NO: 28 - protein, 147 aa, Homo sapiens
MASHRLLLLCLAGLVFVSEAGPTGTGESKCPLMVKVLDAVRGSPAINVAVHVFRKAADDTWEPFASGKTSESGELHGLTTEEEFVEGIYKVEIDTKSYWKALGISPFHEHAEVVFTANDSGPRRYTIAALLSPYSYSTTAVVTNPKE

SEQ ID NO: 29 - DNA, 15391 bp, Homo sapiens
tctacctcgcgggtgcctctggtgtctccagaggtctccgaccccagcccgcccccagccctcccgcccagcccgcagccccctccctctgttccccgacctcagaccctgggcttccgacctcgacatcatgggtgacgcagaaggcgaagacgaggtccagttcctgcggacggacgatgaggtggtcctgcagtgcagcgctaccgtgctcaaggagcagctcaagctctgcctggccgccgagggcttcggcaaccgcctgtgcttcctggagcccactagcaacgcgcagaatgtgccccccgatctggccatctgttgcttcgtcctggagcagtccctgtctgtgcgagccctgcaggagatgctggctaacacggtggaggctggcgtggagtcatcccagggcgggggacacaggacgctcctgtatggccatgccatcctgctccggcatgcacacagccgcatgtatctgagctgcctcaccacctcccgctccatgactgacaagctggccttcgatgtgggactgcaggaggacgcaacaggagaggcttgctggtggaccatgcacccagcctccaagcagaggtctgaaggagaaaaggtccgcgttggggatgacatcatccttgtcagtgtctcctccgagcgctacctgcacctgtcgaccgccagtggggagctccaggttgacgcttccttcatgcagacactatggaacatgaaccccatctgctcccgctgcgaagagggcttcgtgacgggaggtcacgtcctccgcctctttcatggacatatggatgagtgtctgaccatttcccctgctgacagtgatgaccagcgcagacttgtctactatgaggggggagctgtgtgcactcatgcccgctccctctggaggctggagccactgagaatcagctggagtgggagccacctgcgctggggccagccactccgagtccggcatgtcactaccgggcagtacctagcgctcaccgaggaccagggcctggtggtggttgacgccagcaaggctcacaccaaggctacctccttctgcttccgcatctccaaggagaagctggatgtggcccccaagcgggatgtggagggcatgggcccccctgagatcaagtacggggagtcactgtgcttcgtgcagcatgtggcctcaggactgtggctcacctatgctgctccagaccccaaggccctgcggctcggcgtgctcaagaagaaggccatgctgcaccaggagggccacatggacgacgcactgtcgctgacccgctgccagcaggaggagtcccaggccgcccgcatgatccacagcaccaatggcctatacaaccagttcatcaagagcctggacagcttcagcgggaagccacggggctcggggccacccgctggcacggcgctgcccatcgagggcgttatcctgagcctgcaggacctcatcatctacttcgagcctccctccgaggacttgcagcacgaggagaagcagagcaagctgcgaagcctgcgcaaccgccagagcctcttccaggaggaggggatgctctccatggtcctgaattgcatagaccgcctaaatgtctacaccactgctgcccactttgctgagtttgcaggggaggaggcagccgagtcctggaaagagattgtgaatcttctctatgaactcctagcttctctaatccgtggcaatcgtagcaactgtgccctcttctccacaaacttggactggctggtcagcaagctggatcggctggaggcctcgtctggcatcctggaggtcctgtactgtgtcctcattgagagtccagaggttctgaacatcatccaggagaatcacatcaagtccatcatctccctcctggacaagcatgggaggaaccacaaggtcctggacgtgctatgctccctgtgtgtgtgtaatggtgtggctgtacgctccaaccaagatcttattactgagaacttgctgcctggccgtgagcttctgctgcagacaaacctcatcaactatgtcaccagcatccgccccaacatctttgtgggccgagcggaaggcaccacgcagtacagcaaatggtactttgaggtgatggtggacgaggtgactccatttctgacagctcaggccacccacttgcgggtgggctgggccctcaccgagggctacaccccctaccctggggccggcgagggctggggcggcaacggggtcggcgatgacctctattcctacggctttgatggactgcatctctggacaggacacgtggcacgcccagtgacttccccagggcagcacctcctggcccctgaagacgtgatcagctgctgcctggacctcagcgtgccgtccatctccttccgcatcaacggctgccccgtgcagggtgtctttgagtccttcaacctggacgggctcttcttccctgttgtcagcttctcggctggtgtcaaggtgcggttcctccttggtggccgccatggtgaattcaagttcctgcccccacctggctatgctccatgccatgaggctgtgctccctcgagagcgactccatcttgaacccatcaaggagtatcgacgggaggggccccgggggcctcacctggtgggccccagtcgctgcctctcacacaccgacttcgtgccctgccctgtggacactgtccagattgtcctgccgccccatctggagcgcattcgggagaagctggcggagaacatccacgagctctgggcgctaacccgcatcgagcagggctggacctacggcccggttcgggatgacaacaagaggctgcacccgtgtcttgtggacttccacagccttccagagcctgagaggaactacaacctgcagatgtctggggagacgctcaagactctgctggctctgggctgccacgtgggcatggcggatgagaaggcggaggacaacctgaagaagacaaaactccccaagacgtatatgatgagcaatgggtacaagccggctccgctggacctgagccacgtgcggctgacgccggcgcagacgacactggtggaccgtctggcagaaaatgggcacaacgtgtgggcccgagaccgcgtgggccagggctggagctacagcgcagtgcaggacatcccagcgcgccgaaaccctcggctggtgccctaccgcctgctggatgaagccaccaagcgcagcaaccgggacagcctctgccaggccgtgcgcaccctcctgggctacggctacaacatcgagcctcctgaccaggagcccagtcaggtggagaaccagtctcgttgtgaccgggtgcgcatcttccgggcagagaaatcctatacagtgcagagcggccgctggtacttcgagtttgaagcagtcaccacaggcgagatgcgcgtgggctgggcgaggcccgagctgaggcctgatgtagagctgggagctgacgagctggcctatgtcttcaatgggcaccgcggccagcgctggcacttgggcagtgaaccatttgggcgcccctggcagccgggcgatgtcgttggctgtatgatcgacctcacagagaacaccattatcttcaccctcaatggcgaggtcctcatgtctgactcaggctccgaaacagccttccgggagattgagattggggacggcttcctgcccgtctgcagcttgggacctggccaggtgggtcatctgaacctgggccaggacgtgagctctctgaggttctttgccatctgtggcctccaggaaggcttcgagccatttgccatcaacatgcagcgcccagtcaccacctggttcagcaaaggcctgccccagtttgagccagtgccccttgaacaccctcactatgaggtatcccgagtggacggcactgtggacacgcccccctgcctgcgcctgacccaccgcacctggggctcccagaacagcctggtggagatgcttttcctgcggctgagcctcccagtccagttccaccagcacttccgctgcactgcaggggccaccccgctggcacctcctggcctgcagccccccgccgaggacgaggcccgggcggcggaacccgaccctgactacgaaaacctgcgccgctcagctgggggctggagcgaggcagagaacggcaaagaagggactgcgaaggagggcgcccccgggggcaccccgcaggcggggggagaggcgcagcccgccagggcggagaatgagaaggatgccaccaccgagaagaacaagaagagaggcttcttattcaaggccaagaaggtcgccatgatgacccagccaccggccacccccacgctgccccgactccctcacgacgtggtgcctgcagacaaccgcgatgaccccgagatcatcctcaacaccaccacgtactattactccgtgagggtctttgctggacaggagcccagctgcgtgtgggcgggctgggtcacccctgactaccatcagcacgacatgagcttcgacctcagcaaggtccgggtcgtgacggtgaccatgggggatgaacaaggcaacgtccacagcagcctcaagtgtagcaactgctacatggtgtggggcggagactttgtgagtcccgggcagcagggccggatcagccacacggaccttgtcattgggtgcctggtggacttggccactggcttaatgacctttacagccaatggcaaagagagcaacacctttttccaggtggaacccaacactaagctatttcctgccgtcttcgtcctgcccacccaccagaacgtcatccagtttgagctggggaagcagaagaacatcatgccgttgtcagccgccatgttccaaagcgagcgcaagaacccggccccgcagtgcccaccgcggctggagatgcagatgctgatgccagtgtcctggagccgcatgcccaaccacttcctgcaggtggagacgaggcgtgccggcgagcggctgggctgggccgtgcagtgccaggagccgctgaccatgatggcgctgcacatccccgaggagaaccggtgcatggacatcctggagctgtcggagcgcctggacctgcagcgcttccactcgcacaccctgcgcctctaccgcgctgtgtgcgccctgggcaacaatcgcgtggcgcacgctctgtgcagccacgtagaccaagctcagctgctgcacgccctggaggacgcgcacctgccaggcccactgcgcgcaggctactatgacctcctcatcagcatccacctcgaaagtgcctgccgcagccgccgctccatgctctctgaatacatcgtgcccctcacgcctgagacccgcgccatcacgctcttccctcctggaaggagcacagaaaatggtcacccccggcatggcctgccgggagttggagtcaccacttcgctgaggcccccgcatcatttctcgcccccctgtttcgtggccgctctgccagctgctggggcagcagaggccccggcccgcctcagccctgccatcccgctggaggccctgcgggacaaggcactgaggatgctgggggaggcggtgcgcgacggtgggcagcacgctcgcgaccccgtcgggggctccgtggagttccagtttgtgcctgtgctcaagctcgtgtccaccctgctggtgatgggcatctttggcgatgaggatgtgaaacagatcttgaagatgattgagcctgaggtcttcactgaggaagaagaggaggaggacgaggaggaagagggtgaagaggaagatgaggaggagaaggaggaggatgaggaggaaacagcacaggaaaaggaagatgaggaaaaagaggaagaggaggcagcagaaggggagaaagaagaaggcttggaggaagggctgctccagatgaagttgccagagtctgtgaagttacagatgtgccacctgctggagtatttctgtgaccaagagctgcagcaccgtgtggagtccctggcagcctttgcggagcgctatgtggacaagctccaggccaaccagcggagccgctatggcctcctcataaaagccttcagcatgaccgcagcagagactgcaagacgtacccgcgagttccgctccccaccccaggaacagatcaatatgctattgcaattcaaagatggtacagatgaggaagactgtcctctccctgaagagattcgacaggatttgcttgactttcatcaagacctgctggcacactgtggaattcagctagatggagaggaggaggaaccagaggaagagaccaccctgggcagccgcctcatgagcctgttggagaaagtgcggctggtgaagaagaaggaagagaaacctgaggaggagcggtcagcagaggagagcaaaccccggtccctgcaggagctggtgtcccacatggtggtgcgctgggcccaagaggacttcgtgcagagccccgagctggtgcgggccatgttcagcctcctgcaccggcagtacgacgggctgggtgagctgctgcgtgccctgccgcgggcgtacaccatctcaccgtcctccgtggaagacaccatgagcctgctcgagtgcctcggccagatccgctcgctgctcatcgtgcagatgggcccccaggaggagaacctcatgatccagagcatcgggaacatcatgaacaacaaagtcttctaccaacacccgaacctgatgagggcgctgggcatgcacgagacggtcatggaggtcatggtcaacgtcctcgggggcggcgagtccaaggagatccgcttccccaagatggtgacaagctgctgccgcttcctctgctatttctgccgaatcagccggcagaaccagcgctccatgtttgaccacctgagctacctgctggagaacagtggcatcggcctgggcatgcagggctccacgcccctggacgtggctgctgcctccgtcattgacaacaatgagctggccttggcattgcaggagcaggacctggaaaaggttgtgtcctacctggcaggctgtggcctccagagctgccccatgcttgtggccaaagggtacccagacattggctggaacccctgtggtggagagcgctacctggacttcctgcgctttgctgtcttcgtcaacggcgagagcgtggaggagaacgccaatgtggtggtgcggctgctcatccggaagcctgagtgcttcggacccgccctgcggggtgagggtggctcagggctgctggctgccatcgaagaggccatccgcatctccgaggaccctgcgagggatggcccaggcatccgcagggaccggcggcgcgagcactttggtgaggaaccgcctgaagaaaaccgggtgcacctgggacacgccatcatgtccttctatgccgccttgatcgacctgctcggacgctgtgcaccagagatgcatctaatccaagccggcaagggtgaggccctgcggatccgcgccatcctccgctcccttgtgcccttggaggaccttgtgggcatcatcagcctcccactgcagattcccaccctgggcaaagatggggctctggtgcagccaaagatgtcagcatccttcgtgccggaccacaaggcgtccatggtgctcttcctggaccgtgtgtatggcatcgagaaccaggacttcttgctgcacgtgctggacgtggggttcctgcccgacatgagggcagccgcctcgctggacacggccactttcagcaccaccgagatggcgctggcgctgaaccgctacctgtgcctggccgtgctgccgctcatcaccaagtgtgcgccgctctttgcgggcacagaacaccgcgccatcatggtggactctatgctgcataccgtgtaccgcctgtctcggggtcgttcgctcaccaaggcgcagcgtgacgtcatcgaggactgcctcatgtcgctctgcaggtacatccgcccgtcgatgctgcagcacctgttgcgccgcctggtgttcgacgtgcccatcctcaacgagttcgccaagatgccactcaagctcctcaccaaccactatgagcgctgttggaagtactactgcctacccacgggctgggccaacttcggggtcacctcagaggaggagctgcacctcacacggaaactcttctggggcatctttgactctctggcccataagaaatacgacccggagctgtaccgcatggccatgccttgtctgtgcgccattgccggggctctgccccccgactatgtggatgcctcatactcatctaaggcagagaaaaaggccacagtggatgctgaaggcaactttgatccccggcctgtggagaccctcaatgtgatcatcccggagaagctggactccttcattaacaagtttgcggagtacacacacgagaagtgggccttcgacaagatccagaacaactggtcctatggagagaacatagacgaggagctgaagacccaccccatgctgaggccctacaagaccttttcagagaaggacaaagagatttaccgctggcccatcaaggagtccctgaaggccatgattgcctgggaatggacgatagagaaggccagggagggtgaggaggagaagacggaaaagaaaaaaacgcggaagatatcacaaagtgcccagacctatgatcctcgagaaggctacaaccctcagccccccgaccttagtgctgttaccctgtcccgggagctgcaggccatggcagaacaactggcagaaaattaccacaacacgtggggacggaagaagaagcaggagctggaagccaaaggcggtgggacccaccccctgctggtcccctacgacacgctcacggccaaggagaaggcacgagatcgagagaaggcccaggagctactgaaattcctgcagatgaatggctacgcggttacaagaggccttaaggacatggaactggactcgtcttccattgaaaagcggtttgcctttggcttcctgcagcagctgctgcgctggatggacatttctcaggagttcattgcccacctggaggctgtggtcagcagtgggcgagtggaaaagtccccacatgaacaggagattaaattctttgccaagatcctgctccctttgatcaaccagtacttcaccaaccactgcctctatttcttgtccactccggctaaagtgctgggcagcggtggccacgcctctaacaaggagaaggaaatgatcaccagcctcttctgcaaacttgctgctctcgtccgccaccgagtctctctctttgggacagacgccccagctgtggtcaactgtcttcacatcctggcccgctccctggatgccaggacagtgatgaagtcaggccctgagatcgtgaaggctggcctccgctccttcttcgagagtgcctcggaggacatcgagaagatggtggagaacctgcggctgggcaaggtgtcgcaggcgcgcacccaggtgaaaggcgtgggccagaacctcacctacaccactgtggcactgctgccggtcctcaccaccctcttccagcacatcgcccagcaccagttcggagatgacgtcatcctggacgacgtccaggtctcttgctaccgaacgctgtgcagtatctactccctgggaaccaccaagaacacttatgtggaaaagcttcggccagccctcggggagtgcctggcccgtctggcagcagccatgccggtggcgttcctggagccgcagctgaacgagtacaacgcctgctccgtgtacaccaccaagtctccgcgggagcgggccatcctggggctccccaacagtgtggaggagatgtgtcccgacatcccggtgctggagcggctcatggcagacattggggggctggccgagtcaggtgcccgctacacagagatgccgcatgtcatcgagatcacgctgcccatgctatgcagctacctgccccgatggtgggagcgcgggcccgaggcacccccttccgccctgcccgccggcgcccccccaccctgcacagctgtcacctctgaccacctcaactccctgctggggaatatcctgagaatcatcgtcaacaacctgggcattgacgaggcctcctggatgaagcggctggctgtgttcgcacagcccattgtgagccgtgcacggccggagctcctgcagtcccacttcatcccaactatcgggcggctgcgcaagagggcagggaaggtggtgtccgaggaggagcagctgcgcctggaggccaaggcggaggcccaggagggcgagctgctggtgcgggacgagttctctgtgctctgccgggacctctacgccctgtatccgctgctcatccgctacgtggacaacaacagggcgcagtggctgacggagccgaatcccagcgcggaggagctgttcaggatggtgggcgagatcttcatctactggtccaagtcccacaacttcaagcgcgaggagcagaactttgtggtccagaatgagatcaacaacatgtccttcctgactgctgacaacaaaagcaaaatggctaaggcgggagatatacagtccggtggctcggaccaggaacgcaccaagaagaagcgccggggggaccggtactctgtgcagacgtcactgatcgtggccacactgaagaagatgctgcccatcggcctgaatatgtgtgcgcccaccgaccaagacctcatcacgctggccaagacccgttacgccctgaaagacacagatgaggaggtccgggaatttctgcacaacaaccttcaccttcagggaaaggtcgaaggctccccgtctctgcgctggcagatggctctgtaccggggcgtcccgggtcgcgaggaggacgccgatgaccccgagaaaatcgtgcgcagagtccaggaagtgtcagccgtgctctactacctggaccagaccgagcacccttacaagtctaagaaggccgtgtggcacaagcttttgtccaaacagcgccggcgggcagtcgtggcctgtttccgtatgacgcccctgtacaacctgcccacgcaccgggcatgtaacatgttcctggagagctacaaggctgcatggatcctgactgaagaccacagttttgaggaccgcatgatagatgacctttcaaaagctggggagcaggaggaggaggaggaagaggtggaagagaagaagccagaccccctgcaccagttggtcctgcacttcagccgcactgccctgacggaaaagagcaaactggatgaggattacctgtacatggcctatgctgatatcatggcaaagagctgccacctggaggagggaggggagaacggtgaagctgaagaggaggttgaggtctcctttgaggagaaacagatggagaagcagaggctcttgtaccagcaagcacggctgcacacccggggggcggccgagatggtgctgcagatgatcagtgcctgcaaaggagagacaggtgccatggtgtcctccaccctgaagctgggcatctccatcctcaatggaggcaatgctgaggtccagcagaaaatgctggattatcttaaggacaagaaggaagttggcttcttccagagtatccaggcactgatgcaaacatgcagcgtcctggatctcaatgcctttgagagacagaacaaggccgaggggctgggcatggtgaatgaggatggcactgtcatcaatcgccagaacggagagaaggtcatggcggatgatgaattcacacaagacctgttccgattcctacaattgctctgtgaggggcacaataatgatttccagaactacctacggacacagacagggaacacgaccactattaacatcatcatttgcactgtggactacctcctgcggctgcaggaatccatcagcgacttctactggtactactcgggcaaggatgtcattgaagagcagggcaagaggaacttctccaaagccatgtcggtggctaagcaggtgttcaacagcctcactgagtacatccagggtccctgcaccgggaaccagcagagcctggcgcacagtcgcctatgggacgcagtggtgggattcctgcacgtgttcgcccacatgatgatgaagctcgctcaggactcaagccagatcgagctgctgaaggagctgctggatctgcagaaggacatggtggtgatgttgctgtcgctactagaagggaacgtggtgaacggcatgatcgcccggcagatggtggacatgctcgtggaatcctcatccaatgtggagatgatcctcaagttcttcgacatgttcctgaaactcaaggacattgtgggctctgaagccttccaggactacgtaacggatccccgtggcctcatctccaagaaggacttccagaaggccatggacagccagaagcagttcagcggtccagaaatccagttcctgctttcgtgctccgaagcggatgagaacgaaatgatcaactgcgaagagttcgccaaccgcttccaggagccagcacgcgacatcggcttcaacgtggcggtgctgctgaccaacctgtcggagcatgtgccgcatgaccctcgcctgcacaacttcctggagctggccgagagcatccttgagtacttccgcccctacctgggccgcatcgagatcatgggcgcgtcacgccgcatcgagcgcatctacttcgagatctcagagaccaaccgcgcccagtgggagatgccccaggtgaaggagtccaagcgccagttcatcttcgacgtggtgaacgagggcggcgaggctgagaagatggagctcttcgtgagtttctgcgaggacaccatcttcgagatgcagatcgccgcgcagatctcggagcccgagggcgagccggagaccgacgaggacgagggcgcgggcgcggcggaggcgggcgcggaaggcgcggaggagggcgcggcggggctcgagggcacggcggccacggcggcggcgggggcgacggcgcgggttgtggcggccgcaggccgggccctgcgaggcctcagctaccgcagcctgcggcggcgcgtgcggcggctgcggcggcttacggcccgcgaggcggccaccgcagtggcggcgctgctctgggcagcagtgacgcgcgctggggccgctggcgcgggggcggcggcgggcgcgctgggcctgctctggggctcgctgttcggcggcggcctggtggagggcgccaagaaggtgacggtgaccgagctcctggcaggcatgcccgaccccaccagcgacgaggtgcacggcgagcagccggccgggccgggcggagacgcagacggcgagggtgccagcgagggcgctggagacgccgcggagggcgctggagacgaggaggaggcggtgcacgaggccgggccgggcggtgccgacggggcggtggccgtgaccgatgggggccccttccggcccgaaggggctggcggtctcggggacatgggggacacgacgcctgcggaaccgcccacacccgagggctctcccatcctcaagaggaaattgggggtggatggagtggaggaggagctcccgccagagccagagcccgagccggaaccagagctggagccggagaaagccgatgccgagaatggggagaaggaagaagttcccgagcccacaccagagccccccaagaagcaagcacctccctcaccccctccaaagaaggaggaagctggaggcgaattctggggagaactggaggtgcagagggtgaagttcctgaactacctgtcccggaacttttacaccctgcggttccttgccctcttcttggcatttgccatcaacttcatcttgctgttttataaggtctcagactctccaccaggggaggacgacatggaaggctcagctgctggggatgtgtcaggtgcaggctctggtggcagctctggctggggcttgggggccggagaggaggcagagggcgatgaggatgagaacatggtgtactacttcctggaggaaagcacaggctacatggaacccgccctgcggtgtctgagcctcctgcatacactggtggcctttctctgcatcattggctataattgtctcaaggtgcccctggtaatctttaagcgggagaaggagctggcccggaagctggagtttgatggcctgtacatcacggagcagcctgaggacgatgacgtgaaggggcagtgggaccgactggtgctcaacacgccgtctttccctagcaactactgggacaagtttgtcaagcgcaaggtcctggacaaacatggggacatctacgggcgggagcggattgctgagctactgggcatggacctggccacactagagatcacagcccacaatgagcgcaagcccaacccgccgccagggctgctgacctggctcatgtccatcgatgtcaagtaccagatctggaagttcggggtcatcttcacagacaactccttcctgtacctgggctggtatatggtgatgtccctcttgggacactacaacaacttcttctttgctgcccatctcctggacatcgccatgggggtcaagacgctgcgcaccatcctgtcctctgtcacccacaatgggaaacagctggtgatgaccgtgggccttctggcggtggtcgtctacctgtacaccgtggtggccttcaacttcttccgcaagttctacaacaagagcgaggatgaggatgaacctgacatgaagtgtgatgacatgatgacgtgttacctgtttcacatgtacgtgggtgtccgggctggcggaggcattggggacgagatcgaggaccccgcgggtgacgaatacgagctctacagggtggtcttcgacatcaccttcttcttcttcgtcatcgtcatcctgttggccatcatccagggtctgatcatcgacgcttttggtgagctccgagaccaacaagagcaagtgaaggaggatatggagaccaagtgcttcatctgtggaatcggcagtgactactttgatacgacaccgcatggcttcgagactcacacgctggaggagcacaacctggccaattacatgtttttcctgatgtatttgataaacaaggatgagacagaacacacgggtcaggagtcttatgtctggaagatgtaccaagagagatgttgggatttcttcccagctggtgattgtttccgtaagcagtatgaggaccagcttagctgacacacccccagctggccctccacccccacctcaagtgccttattctcacagcaagccccttagtccccaagcccctccccctaaggcagctgggggagaggtgacctagtactggaaaataaatctgtgctacgccccccagca

SEQ ID NO: 30 - protein, 5038 aa, Homo sapiens
MGDAEGEDEVQFLRTDDEVVLQCSATVLKEQLKLCLAAEGFGNRLCFLEPTSNAQNVPPDLAICCFVLEQSLSVRALQEMLANTVEAGVESSQGGGHRTLLYGHAILLRHAHSRMYLSCLTTSRSMTDKLAFDVGLQEDATGEACWWTMHPASKQRSEGEKVRVGDDIILVSVSSERYLHLSTASGELQVDASFMQTLWNMNPICSRCEEGFVTGGHVLRLFHGHMDECLTISPADSDDQRRLVYYEGGAVCTHARSLWRLEPLRISWSGSHLRWGQPLRVRHVTTGQYLALTEDQGLVVVDASKAHTKATSFCFRISKEKLDVAPKRDVEGMGPPEIKYGESLCFVQHVASGLWLTYAAPDPKALRLGVLKKKAMLHQEGHMDDALSLTRCQQEESQAARMIHSTNGLYNQFIKSLDSFSGKPRGSGPPAGTALPIEGVILSLQDLIIYFEPPSEDLQHEEKQSKLRSLRNRQSLFQEEGMLSMVLNCIDRLNVYTTAAHFAEFAGEEAAESWKEIVNLLYELLASLIRGNRSNCALFSTNLDWLVSKLDRLEASSGILEVLYCVLIESPEVLNIIQENHIKSIISLLDKHGRNHKVLDVLCSLCVCNGVAVRSNQDLITENLLPGRELLLQTNLINYVTSIRPNIFVGRAEGTTQYSKWYFEVMVDEVTPFLTAQATHLRVGWALTEGYTPYPGAGEGWGGNGVGDDLYSYGFDGLHLWTGHVARPVTSPGQHLLAPEDVISCCLDLSVPSISFRINGCPVQGVFESFNLDGLFFPVVSFSAGVKVRFLLGGRHGEFKFLPPPGYAPCHEAVLPRERLHLEPIKEYRREGPRGPHLVGPSRCLSHTDFVPCPVDTVQIVLPPHLERIREKLAENIHELWALTRIEQGWTYGPVRDDNKRLHPCLVDFHSLPEPERNYNLQMSGETLKTLLALGCHVGMADEKAEDNLKKTKLPKTYMMSNGYKPAPLDLSHVRLTPAQTTLVDRLAENGHNVWARDRVGQGWSYSAVQDIPARRNPRLVPYRLLDEATKRSNRDSLCQAVRTLLGYGYNIEPPDQEPSQVENQSRCDRVRIFRAEKSYTVQSGRWYFEFEAVTTGEMRVGWARPELRPDVELGADELAYVFNGHRGQRWHLGSEPFGRPWQPGDVVGCMIDLTENTIIFTLNGEVLMSDSGSETAFREIEIGDGFLPVCSLGPGQVGHLNLGQDVSSLRFFAICGLQEGFEPFAINMQRPVTTWFSKGLPQFEPVPLEHPHYEVSRVDGTVDTPPCLRLTHRTWGSQNSLVEMLFLRLSLPVQFHQHFRCTAGATPLAPPGLQPPAEDEARAAEPDPDYENLRRSAGGWSEAENGKEGTAKEGAPGGTPQAGGEAQPARAENEKDATTEKNKKRGFLFKAKKVAMMTQPPATPTLPRLPHDVVPADNRDDPEIILNTTTYYYSVRVFAGQEPSCVWAGWVTPDYHQHDMSFDLSKVRVVTVTMGDEQGNVHSSLKCSNCYMVWGGDFVSPGQQGRISHTDLVIGCLVDLATGLMTFTANGKESNTFFQVEPNTKLFPAVFVLPTHQNVIQFELGKQKNIMPLSAAMFQSERKNPAPQCPPRLEMQMLMPVSWSRMPNHFLQVETRRAGERLGWAVQCQEPLTMMALHIPEENRCMDILELSERLDLQRFHSHTLRLYRAVCALGNNRVAHALCSHVDQAQLLHALEDAHLPGPLRAGYYDLLISIHLESACRSRRSMLSEYIVPLTPETRAITLFPPGRSTENGHPRHGLPGVGVTTSLRPPHHFSPPCFVAALPAAGAAEAPARLSPAIPLEALRDKALRMLGEAVRDGGQHARDPVGGSVEFQFVPVLKLVSTLLVMGIFGDEDVKQILKMIEPEVFTEEEEEEDEEEEGEEEDEEEKEEDEEETAQEKEDEEKEEEEAAEGEKEEGLEEGLLQMKLPESVKLQMCHLLEYFCDQELQHRVESLAAFAERYVDKLQANQRSRYGLLIKAFSMTAAETARRTREFRSPPQEQINMLLQFKDGTDEEDCPLPEEIRQDLLDFHQDLLAHCGIQLDGEEEEPEEETTLGSRLMSLLEKVRLVKKKEEKPEEERSAEESKPRSLQELVSHMVVRWAQEDFVQSPELVRAMFSLLHRQYDGLGELLRALPRAYTISPSSVEDTMSLLECLGQIRSLLIVQMGPQEENLMIQSIGNIMNNKVFYQHPNLMRALGMHETVMEVMVNVLGGGESKEIRFPKMVTSCCRFLCYFCRISRQNQRSMFDHLSYLLENSGIGLGMQGSTPLDVAAASVIDNNELALALQEQDLEKVVSYLAGCGLQSCPMLVAKGYPDIGWNPCGGERYLDFLRFAVFVNGESVEENANVVVRLLIRKPECFGPALRGEGGSGLLAAIEEAIRISEDPARDGPGIRRDRRREHFGEEPPEENRVHLGHAIMSFYAALIDLLGRCAPEMHLIQAGKGEALRIRAILRSLVPLEDLVGIISLPLQIPTLGKDGALVQPKMSASFVPDHKASMVLFLDRVYGIENQDFLLHVLDVGFLPDMRAAASLDTATFSTTEMALALNRYLCLAVLPLITKCAPLFAGTEHRAIMVDSMLHTVYRLSRGRSLTKAQRDVIEDCLMSLCRYIRPSMLQHLLRRLVFDVPILNEFAKMPLKLLTNHYERCWKYYCLPTGWANFGVTSEEELHLTRKLFWGIFDSLAHKKYDPELYRMAMPCLCAIAGALPPDYVDASYSSKAEKKATVDAEGNFDPRPVETLNVIIPEKLDSFINKFAEYTHEKWAFDKIQNNWSYGENIDEELKTHPMLRPYKTFSEKDKEIYRWPIKESLKAMIAWEWTIEKAREGEEEKTEKKKTRKISQSAQTYDPREGYNPQPPDLSAVTLSRELQAMAEQLAENYHNTWGRKKKQELEAKGGGTHPLLVPYDTLTAKEKARDREKAQELLKFLQMNGYAVTRGLKDMELDSSSIEKRFAFGFLQQLLRWMDISQEFIAHLEAVVSSGRVEKSPHEQEIKFFAKILLPLINQYFTNHCLYFLSTPAKVLGSGGHASNKEKEMITSLFCKLAALVRHRVSLFGTDAPAVVNCLHILARSLDARTVMKSGPEIVKAGLRSFFESASEDIEKMVENLRLGKVSQARTQVKGVGQNLTYTTVALLPVLTTLFQHIAQHQFGDDVILDDVQVSCYRTLCSIYSLGTTKNTYVEKLRPALGECLARLAAAMPVAFLEPQLNEYNACSVYTTKSPRERAILGLPNSVEEMCPDIPVLERLMADIGGLAESGARYTEMPHVIEITLPMLCSYLPRWWERGPEAPPSALPAGAPPPCTAVTSDHLNSLLGNILRIIVNNLGIDEASWMKRLAVFAQPIVSRARPELLQSHFIPTIGRLRKRAGKVVSEEEQLRLEAKAEAQEGELLVRDEFSVLCRDLYALYPLLIRYVDNNRAQWLTEPNPSAEELFRMVGEIFIYWSKSHNFKREEQNFVVQNEINNMSFLTADNKSKMAKAGDIQSGGSDQERTKKKRRGDRYSVQTSLIVATLKKMLPIGLNMCAPTDQDLITLAKTRYALKDTDEEVREFLHNNLHLQGKVEGSPSLRWQMALYRGVPGREEDADDPEKIVRRVQEVSAVLYYLDQTEHPYKSKKAVWHKLLSKQRRRAVVACFRMTPLYNLPTHRACNMFLESYKAAWILTEDHSFEDRMIDDLSKAGEQEEEEEEVEEKKPDPLHQLVLHFSRTALTEKSKLDEDYLYMAYADIMAKSCHLEEGGENGEAEEEVEVSFEEKQMEKQRLLYQQARLHTRGAAEMVLQMISACKGETGAMVSSTLKLGISILNGGNAEVQQKMLDYLKDKKEVGFFQSIQALMQTCSVLDLNAFERQNKAEGLGMVNEDGTVINRQNGEKVMADDEFTQDLFRFLQLLCEGHNNDFQNYLRTQTGNTTTINIIICTVDYLLRLQESISDFYWYYSGKDVIEEQGKRNFSKAMSVAKQVFNSLTEYIQGPCTGNQQSLAHSRLWDAVVGFLHVFAHMMMKLAQDSSQIELLKELLDLQKDMVVMLLSLLEGNVVNGMIARQMVDMLVESSSNVEMILKFFDMFLKLKDIVGSEAFQDYVTDPRGLISKKDFQKAMDSQKQFSGPEIQFLLSCSEADENEMINCEEFANRFQEPARDIGFNVAVLLTNLSEHVPHDPRLHNFLELAESILEYFRPYLGRIEIMGASRRIERIYFEISETNRAQWEMPQVKESKRQFIFDVVNEGGEAEKMELFVSFCEDTIFEMQIAAQISEPEGEPETDEDEGAGAAEAGAEGAEEGAAGLEGTAATAAAGATARVVAAAGRALRGLSYRSLRRRVRRLRRLTAREAATAVAALLWAAVTRAGAAGAGAAAGALGLLWGSLFGGGLVEGAKKVTVTELLAGMPDPTSDEVHGEQPAGPGGDADGEGASEGAGDAAEGAGDEEEAVHEAGPGGADGAVAVTDGGPFRPEGAGGLGDMGDTTPAEPPTPEGSPILKRKLGVDGVEEELPPEPEPEPEPELEPEKADAENGEKEEVPEPTPEPPKKQAPPSPPPKKEEAGGEFWGELEVQRVKFLNYLSRNFYTLRFLALFLAFAINFILLFYKVSDSPPGEDDMEGSAAGDVSGAGSGGSSGWGLGAGEEAEGDEDENMVYYFLEESTGYMEPALRCLSLLHTLVAFLCIIGYNCLKVPLVIFKREKELARKLEFDGLYITEQPEDDDVKGQWDRLVLNTPSFPSNYWDKFVKRKVLDKHGDIYGRERIAELLGMDLATLEITAHNERKPNPPPGLLTWLMSIDVKYQIWKFGVIFTDNSFLYLGWYMVMSLLGHYNNFFFAAHLLDIAMGVKTLRTILSSVTHNGKQLVMTVGLLAVVVYLYTVVAFNFFRKFYNKSEDEDEPDMKCDDMMTCYLFHMYVGVRAGGGIGDEIEDPAGDEYELYRVVFDITFFFFVIVILLAIIQGLIIDAFGELRDQQEQVKEDMETKCFICGIGSDYFDTTPHGFETHTLEEHNLANYMFFLMYLINKDETEHTGQESYVWKMYQERCWDFFPAGDCFRKQYEDQLS

SEQ ID NO: 31 - DNA, 15376 bp, Homo sapiens
tctacctcgcgggtgcctctggtgtctccagaggtctccgaccccagcccgcccccagccctcccgcccagcccgcagccccctccctctgttccccgacctcagaccctgggcttccgacctcgacatcatgggtgacgcagaaggcgaagacgaggtccagttcctgcggacggacgatgaggtggtcctgcagtgcagcgctaccgtgctcaaggagcagctcaagctctgcctggccgccgagggcttcggcaaccgcctgtgcttcctggagcccactagcaacgcgcagaatgtgccccccgatctggccatctgttgcttcgtcctggagcagtccctgtctgtgcgagccctgcaggagatgctggctaacacggtggaggctggcgtggagtcatcccagggcgggggacacaggacgctcctgtatggccatgccatcctgctccggcatgcacacagccgcatgtatctgagctgcctcaccacctcccgctccatgactgacaagctggccttcgatgtgggactgcaggaggacgcaacaggagaggcttgctggtggaccatgcacccagcctccaagcagaggtctgaaggagaaaaggtccgcgttggggatgacatcatccttgtcagtgtctcctccgagcgctacctgcacctgtcgaccgccagtggggagctccaggttgacgcttccttcatgcagacactatggaacatgaaccccatctgctcccgctgcgaagagggcttcgtgacgggaggtcacgtcctccgcctctttcatggacatatggatgagtgtctgaccatttcccctgctgacagtgatgaccagcgcagacttgtctactatgaggggggagctgtgtgcactcatgcccgctccctctggaggctggagccactgagaatcagctggagtgggagccacctgcgctggggccagccactccgagtccggcatgtcactaccgggcagtacctagcgctcaccgaggaccagggcctggtggtggttgacgccagcaaggctcacaccaaggctacctccttctgcttccgcatctccaaggagaagctggatgtggcccccaagcgggatgtggagggcatgggcccccctgagatcaagtacggggagtcactgtgcttcgtgcagcatgtggcctcaggactgtggctcacctatgctgctccagaccccaaggccctgcggctcggcgtgctcaagaagaaggccatgctgcaccaggagggccacatggacgacgcactgtcgctgacccgctgccagcaggaggagtcccaggccgcccgcatgatccacagcaccaatggcctatacaaccagttcatcaagagcctggacagcttcagcgggaagccacggggctcggggccacccgctggcacggcgctgcccatcgagggcgttatcctgagcctgcaggacctcatcatctacttcgagcctccctccgaggacttgcagcacgaggagaagcagagcaagctgcgaagcctgcgcaaccgccagagcctcttccaggaggaggggatgctctccatggtcctgaattgcatagaccgcctaaatgtctacaccactgctgcccactttgctgagtttgcaggggaggaggcagccgagtcctggaaagagattgtgaatcttctctatgaactcctagcttctctaatccgtggcaatcgtagcaactgtgccctcttctccacaaacttggactggctggtcagcaagctggatcggctggaggcctcgtctggcatcctggaggtcctgtactgtgtcctcattgagagtccagaggttctgaacatcatccaggagaatcacatcaagtccatcatctccctcctggacaagcatgggaggaaccacaaggtcctggacgtgctatgctccctgtgtgtgtgtaatggtgtggctgtacgctccaaccaagatcttattactgagaacttgctgcctggccgtgagcttctgctgcagacaaacctcatcaactatgtcaccagcatccgccccaacatctttgtgggccgagcggaaggcaccacgcagtacagcaaatggtactttgaggtgatggtggacgaggtgactccatttctgacagctcaggccacccacttgcgggtgggctgggccctcaccgagggctacaccccctaccctggggccggcgagggctggggcggcaacggggtcggcgatgacctctattcctacggctttgatggactgcatctctggacaggacacgtggcacgcccagtgacttccccagggcagcacctcctggcccctgaagacgtgatcagctgctgcctggacctcagcgtgccgtccatctccttccgcatcaacggctgccccgtgcagggtgtctttgagtccttcaacctggacgggctcttcttccctgttgtcagcttctcggctggtgtcaaggtgcggttcctccttggtggccgccatggtgaattcaagttcctgcccccacctggctatgctccatgccatgaggctgtgctccctcgagagcgactccatcttgaacccatcaaggagtatcgacgggaggggccccgggggcctcacctggtgggccccagtcgctgcctctcacacaccgacttcgtgccctgccctgtggacactgtccagattgtcctgccgccccatctggagcgcattcgggagaagctggcggagaacatccacgagctctgggcgctaacccgcatcgagcagggctggacctacggcccggttcgggatgacaacaagaggctgcacccgtgtcttgtggacttccacagccttccagagcctgagaggaactacaacctgcagatgtctggggagacgctcaagactctgctggctctgggctgccacgtgggcatggcggatgagaaggcggaggacaacctgaagaagacaaaactccccaagacgtatatgatgagcaatgggtacaagccggctccgctggacctgagccacgtgcggctgacgccggcgcagacgacactggtggaccgtctggcagaaaatgggcacaacgtgtgggcccgagaccgcgtgggccagggctggagctacagcgcagtgcaggacatcccagcgcgccgaaaccctcggctggtgccctaccgcctgctggatgaagccaccaagcgcagcaaccgggacagcctctgccaggccgtgcgcaccctcctgggctacggctacaacatcgagcctcctgaccaggagcccagtcaggtggagaaccagtctcgttgtgaccgggtgcgcatcttccgggcagagaaatcctatacagtgcagagcggccgctggtacttcgagtttgaagcagtcaccacaggcgagatgcgcgtgggctgggcgaggcccgagctgaggcctgatgtagagctgggagctgacgagctggcctatgtcttcaatgggcaccgcggccagcgctggcacttgggcagtgaaccatttgggcgcccctggcagccgggcgatgtcgttggctgtatgatcgacctcacagagaacaccattatcttcaccctcaatggcgaggtcctcatgtctgactcaggctccgaaacagccttccgggagattgagattggggacggcttcctgcccgtctgcagcttgggacctggccaggtgggtcatctgaacctgggccaggacgtgagctctctgaggttctttgccatctgtggcctccaggaaggcttcgagccatttgccatcaacatgcagcgcccagtcaccacctggttcagcaaaggcctgccccagtttgagccagtgccccttgaacaccctcactatgaggtatcccgagtggacggcactgtggacacgcccccctgcctgcgcctgacccaccgcacctggggctcccagaacagcctggtggagatgcttttcctgcggctgagcctcccagtccagttccaccagcacttccgctgcactgcaggggccaccccgctggcacctcctggcctgcagccccccgccgaggacgaggcccgggcggcggaacccgaccctgactacgaaaacctgcgccgctcagctgggggctggagcgaggcagagaacggcaaagaagggactgcgaaggagggcgcccccgggggcaccccgcaggcggggggagaggcgcagcccgccagggcggagaatgagaaggatgccaccaccgagaagaacaagaagagaggcttcttattcaaggccaagaaggtcgccatgatgacccagccaccggccacccccacgctgccccgactccctcacgacgtggtgcctgcagacaaccgcgatgaccccgagatcatcctcaacaccaccacgtactattactccgtgagggtctttgctggacaggagcccagctgcgtgtgggcgggctgggtcacccctgactaccatcagcacgacatgagcttcgacctcagcaaggtccgggtcgtgacggtgaccatgggggatgaacaaggcaacgtccacagcagcctcaagtgtagcaactgctacatggtgtggggcggagactttgtgagtcccgggcagcagggccggatcagccacacggaccttgtcattgggtgcctggtggacttggccactggcttaatgacctttacagccaatggcaaagagagcaacacctttttccaggtggaacccaacactaagctatttcctgccgtcttcgtcctgcccacccaccagaacgtcatccagtttgagctggggaagcagaagaacatcatgccgttgtcagccgccatgttccaaagcgagcgcaagaacccggccccgcagtgcccaccgcggctggagatgcagatgctgatgccagtgtcctggagccgcatgcccaaccacttcctgcaggtggagacgaggcgtgccggcgagcggctgggctgggccgtgcagtgccaggagccgctgaccatgatggcgctgcacatccccgaggagaaccggtgcatggacatcctggagctgtcggagcgcctggacctgcagcgcttccactcgcacaccctgcgcctctaccgcgctgtgtgcgccctgggcaacaatcgcgtggcgcacgctctgtgcagccacgtagaccaagctcagctgctgcacgccctggaggacgcgcacctgccaggcccactgcgcgcaggctactatgacctcctcatcagcatccacctcgaaagtgcctgccgcagccgccgctccatgctctctgaatacatcgtgcccctcacgcctgagacccgcgccatcacgctcttccctcctggaaggagcacagaaaatggtcacccccggcatggcctgccgggagttggagtcaccacttcgctgaggcccccgcatcatttctcgcccccctgtttcgtggccgctctgccagctgctggggcagcagaggccccggcccgcctcagccctgccatcccgctggaggccctgcgggacaaggcactgaggatgctgggggaggcggtgcgcgacggtgggcagcacgctcgcgaccccgtcgggggctccgtggagttccagtttgtgcctgtgctcaagctcgtgtccaccctgctggtgatgggcatctttggcgatgaggatgtgaaacagatcttgaagatgattgagcctgaggtcttcactgaggaagaagaggaggaggacgaggaggaagagggtgaagaggaagatgaggaggagaaggaggaggatgaggaggaaacagcacaggaaaaggaagatgaggaaaaagaggaagaggaggcagcagaaggggagaaagaagaaggcttggaggaagggctgctccagatgaagttgccagagtctgtgaagttacagatgtgccacctgctggagtatttctgtgaccaagagctgcagcaccgtgtggagtccctggcagcctttgcggagcgctatgtggacaagctccaggccaaccagcggagccgctatggcctcctcataaaagccttcagcatgaccgcagcagagactgcaagacgtacccgcgagttccgctccccaccccaggaacagatcaatatgctattgcaattcaaagatggtacagatgaggaagactgtcctctccctgaagagattcgacaggatttgcttgactttcatcaagacctgctggcacactgtggaattcagctagatggagaggaggaggaaccagaggaagagaccaccctgggcagccgcctcatgagcctgttggagaaagtgcggctggtgaagaagaaggaagagaaacctgaggaggagcggtcagcagaggagagcaaaccccggtccctgcaggagctggtgtcccacatggtggtgcgctgggcccaagaggacttcgtgcagagccccgagctggtgcgggccatgttcagcctcctgcaccggcagtacgacgggctgggtgagctgctgcgtgccctgccgcgggcgtacaccatctcaccgtcctccgtggaagacaccatgagcctgctcgagtgcctcggccagatccgctcgctgctcatcgtgcagatgggcccccaggaggagaacctcatgatccagagcatcgggaacatcatgaacaacaaagtcttctaccaacacccgaacctgatgagggcgctgggcatgcacgagacggtcatggaggtcatggtcaacgtcctcgggggcggcgagtccaaggagatccgcttccccaagatggtgacaagctgctgccgcttcctctgctatttctgccgaatcagccggcagaaccagcgctccatgtttgaccacctgagctacctgctggagaacagtggcatcggcctgggcatgcagggctccacgcccctggacgtggctgctgcctccgtcattgacaacaatgagctggccttggcattgcaggagcaggacctggaaaaggttgtgtcctacctggcaggctgtggcctccagagctgccccatgcttgtggccaaagggtacccagacattggctggaacccctgtggtggagagcgctacctggacttcctgcgctttgctgtcttcgtcaacggcgagagcgtggaggagaacgccaatgtggtggtgcggctgctcatccggaagcctgagtgcttcggacccgccctgcggggtgagggtggctcagggctgctggctgccatcgaagaggccatccgcatctccgaggaccctgcgagggatggcccaggcatccgcagggaccggcggcgcgagcactttggtgaggaaccgcctgaagaaaaccgggtgcacctgggacacgccatcatgtccttctatgccgccttgatcgacctgctcggacgctgtgcaccagagatgcatctaatccaagccggcaagggtgaggccctgcggatccgcgccatcctccgctcccttgtgcccttggaggaccttgtgggcatcatcagcctcccactgcagattcccaccctgggcaaagatggggctctggtgcagccaaagatgtcagcatccttcgtgccggaccacaaggcgtccatggtgctcttcctggaccgtgtgtatggcatcgagaaccaggacttcttgctgcacgtgctggacgtggggttcctgcccgacatgagggcagccgcctcgctggacacggccactttcagcaccaccgagatggcgctggcgctgaaccgctacctgtgcctggccgtgctgccgctcatcaccaagtgtgcgccgctctttgcgggcacagaacaccgcgccatcatggtggactctatgctgcataccgtgtaccgcctgtctcggggtcgttcgctcaccaaggcgcagcgtgacgtcatcgaggactgcctcatgtcgctctgcaggtacatccgcccgtcgatgctgcagcacctgttgcgccgcctggtgttcgacgtgcccatcctcaacgagttcgccaagatgccactcaagctcctcaccaaccactatgagcgctgttggaagtactactgcctacccacgggctgggccaacttcggggtcacctcagaggaggagctgcacctcacacggaaactcttctggggcatctttgactctctggcccataagaaatacgacccggagctgtaccgcatggccatgccttgtctgtgcgccattgccggggctctgccccccgactatgtggatgcctcatactcatctaaggcagagaaaaaggccacagtggatgctgaaggcaactttgatccccggcctgtggagaccctcaatgtgatcatcccggagaagctggactccttcattaacaagtttgcggagtacacacacgagaagtgggccttcgacaagatccagaacaactggtcctatggagagaacatagacgaggagctgaagacccaccccatgctgaggccctacaagaccttttcagagaaggacaaagagatttaccgctggcccatcaaggagtccctgaaggccatgattgcctgggaatggacgatagagaaggccagggagggtgaggaggagaagacggaaaagaaaaaaacgcggaagatatcacaaagtgcccagacctatgatcctcgagaaggctacaaccctcagccccccgaccttagtgctgttaccctgtcccgggagctgcaggccatggcagaacaactggcagaaaattaccacaacacgtggggacggaagaagaagcaggagctggaagccaaaggcggtgggacccaccccctgctggtcccctacgacacgctcacggccaaggagaaggcacgagatcgagagaaggcccaggagctactgaaattcctgcagatgaatggctacgcggttacaagaggccttaaggacatggaactggactcgtcttccattgaaaagcggtttgcctttggcttcctgcagcagctgctgcgctggatggacatttctcaggagttcattgcccacctggaggctgtggtcagcagtgggcgagtggaaaagtccccacatgaacaggagattaaattctttgccaagatcctgctccctttgatcaaccagtacttcaccaaccactgcctctatttcttgtccactccggctaaagtgctgggcagcggtggccacgcctctaacaaggagaaggaaatgatcaccagcctcttctgcaaacttgctgctctcgtccgccaccgagtctctctctttgggacagacgccccagctgtggtcaactgtcttcacatcctggcccgctccctggatgccaggacagtgatgaagtcaggccctgagatcgtgaaggctggcctccgctccttcttcgagagtgcctcggaggacatcgagaagatggtggagaacctgcggctgggcaaggtgtcgcaggcgcgcacccaggtgaaaggcgtgggccagaacctcacctacaccactgtggcactgctgccggtcctcaccaccctcttccagcacatcgcccagcaccagttcggagatgacgtcatcctggacgacgtccaggtctcttgctaccgaacgctgtgcagtatctactccctgggaaccaccaagaacacttatgtggaaaagcttcggccagccctcggggagtgcctggcccgtctggcagcagccatgccggtggcgttcctggagccgcagctgaacgagtacaacgcctgctccgtgtacaccaccaagtctccgcgggagcgggccatcctggggctccccaacagtgtggaggagatgtgtcccgacatcccggtgctggagcggctcatggcagacattggggggctggccgagtcaggtgcccgctacacagagatgccgcatgtcatcgagatcacgctgcccatgctatgcagctacctgccccgatggtgggagcgcgggcccgaggcacccccttccgccctgcccgccggcgcccccccaccctgcacagctgtcacctctgaccacctcaactccctgctggggaatatcctgagaatcatcgtcaacaacctgggcattgacgaggcctcctggatgaagcggctggctgtgttcgcacagcccattgtgagccgtgcacggccggagctcctgcagtcccacttcatcccaactatcgggcggctgcgcaagagggcagggaaggtggtgtccgaggaggagcagctgcgcctggaggccaaggcggaggcccaggagggcgagctgctggtgcgggacgagttctctgtgctctgccgggacctctacgccctgtatccgctgctcatccgctacgtggacaacaacagggcgcagtggctgacggagccgaatcccagcgcggaggagctgttcaggatggtgggcgagatcttcatctactggtccaagtcccacaacttcaagcgcgaggagcagaactttgtggtccagaatgagatcaacaacatgtccttcctgactgctgacaacaaaagcaaaatggctaagtccggtggctcggaccaggaacgcaccaagaagaagcgccggggggaccggtactctgtgcagacgtcactgatcgtggccacactgaagaagatgctgcccatcggcctgaatatgtgtgcgcccaccgaccaagacctcatcacgctggccaagacccgttacgccctgaaagacacagatgaggaggtccgggaatttctgcacaacaaccttcaccttcagggaaaggtcgaaggctccccgtctctgcgctggcagatggctctgtaccggggcgtcccgggtcgcgaggaggacgccgatgaccccgagaaaatcgtgcgcagagtccaggaagtgtcagccgtgctctactacctggaccagaccgagcacccttacaagtctaagaaggccgtgtggcacaagcttttgtccaaacagcgccggcgggcagtcgtggcctgtttccgtatgacgcccctgtacaacctgcccacgcaccgggcatgtaacatgttcctggagagctacaaggctgcatggatcctgactgaagaccacagttttgaggaccgcatgatagatgacctttcaaaagctggggagcaggaggaggaggaggaagaggtggaagagaagaagccagaccccctgcaccagttggtcctgcacttcagccgcactgccctgacggaaaagagcaaactggatgaggattacctgtacatggcctatgctgatatcatggcaaagagctgccacctggaggagggaggggagaacggtgaagctgaagaggaggttgaggtctcctttgaggagaaacagatggagaagcagaggctcttgtaccagcaagcacggctgcacacccggggggcggccgagatggtgctgcagatgatcagtgcctgcaaaggagagacaggtgccatggtgtcctccaccctgaagctgggcatctccatcctcaatggaggcaatgctgaggtccagcagaaaatgctggattatcttaaggacaagaaggaagttggcttcttccagagtatccaggcactgatgcaaacatgcagcgtcctggatctcaatgcctttgagagacagaacaaggccgaggggctgggcatggtgaatgaggatggcactgtcatcaatcgccagaacggagagaaggtcatggcggatgatgaattcacacaagacctgttccgattcctacaattgctctgtgaggggcacaataatgatttccagaactacctacggacacagacagggaacacgaccactattaacatcatcatttgcactgtggactacctcctgcggctgcaggaatccatcagcgacttctactggtactactcgggcaaggatgtcattgaagagcagggcaagaggaacttctccaaagccatgtcggtggctaagcaggtgttcaacagcctcactgagtacatccagggtccctgcaccgggaaccagcagagcctggcgcacagtcgcctatgggacgcagtggtgggattcctgcacgtgttcgcccacatgatgatgaagctcgctcaggactcaagccagatcgagctgctgaaggagctgctggatctgcagaaggacatggtggtgatgttgctgtcgctactagaagggaacgtggtgaacggcatgatcgcccggcagatggtggacatgctcgtggaatcctcatccaatgtggagatgatcctcaagttcttcgacatgttcctgaaactcaaggacattgtgggctctgaagccttccaggactacgtaacggatccccgtggcctcatctccaagaaggacttccagaaggccatggacagccagaagcagttcagcggtccagaaatccagttcctgctttcgtgctccgaagcggatgagaacgaaatgatcaactgcgaagagttcgccaaccgcttccaggagccagcacgcgacatcggcttcaacgtggcggtgctgctgaccaacctgtcggagcatgtgccgcatgaccctcgcctgcacaacttcctggagctggccgagagcatccttgagtacttccgcccctacctgggccgcatcgagatcatgggcgcgtcacgccgcatcgagcgcatctacttcgagatctcagagaccaaccgcgcccagtgggagatgccccaggtgaaggagtccaagcgccagttcatcttcgacgtggtgaacgagggcggcgaggctgagaagatggagctcttcgtgagtttctgcgaggacaccatcttcgagatgcagatcgccgcgcagatctcggagcccgagggcgagccggagaccgacgaggacgagggcgcgggcgcggcggaggcgggcgcggaaggcgcggaggagggcgcggcggggctcgagggcacggcggccacggcggcggcgggggcgacggcgcgggttgtggcggccgcaggccgggccctgcgaggcctcagctaccgcagcctgcggcggcgcgtgcggcggctgcggcggcttacggcccgcgaggcggccaccgcagtggcggcgctgctctgggcagcagtgacgcgcgctggggccgctggcgcgggggcggcggcgggcgcgctgggcctgctctggggctcgctgttcggcggcggcctggtggagggcgccaagaaggtgacggtgaccgagctcctggcaggcatgcccgaccccaccagcgacgaggtgcacggcgagcagccggccgggccgggcggagacgcagacggcgagggtgccagcgagggcgctggagacgccgcggagggcgctggagacgaggaggaggcggtgcacgaggccgggccgggcggtgccgacggggcggtggccgtgaccgatgggggccccttccggcccgaaggggctggcggtctcggggacatgggggacacgacgcctgcggaaccgcccacacccgagggctctcccatcctcaagaggaaattgggggtggatggagtggaggaggagctcccgccagagccagagcccgagccggaaccagagctggagccggagaaagccgatgccgagaatggggagaaggaagaagttcccgagcccacaccagagccccccaagaagcaagcacctccctcaccccctccaaagaaggaggaagctggaggcgaattctggggagaactggaggtgcagagggtgaagttcctgaactacctgtcccggaacttttacaccctgcggttccttgccctcttcttggcatttgccatcaacttcatcttgctgttttataaggtctcagactctccaccaggggaggacgacatggaaggctcagctgctggggatgtgtcaggtgcaggctctggtggcagctctggctggggcttgggggccggagaggaggcagagggcgatgaggatgagaacatggtgtactacttcctggaggaaagcacaggctacatggaacccgccctgcggtgtctgagcctcctgcatacactggtggcctttctctgcatcattggctataattgtctcaaggtgcccctggtaatctttaagcgggagaaggagctggcccggaagctggagtttgatggcctgtacatcacggagcagcctgaggacgatgacgtgaaggggcagtgggaccgactggtgctcaacacgccgtctttccctagcaactactgggacaagtttgtcaagcgcaaggtcctggacaaacatggggacatctacgggcgggagcggattgctgagctactgggcatggacctggccacactagagatcacagcccacaatgagcgcaagcccaacccgccgccagggctgctgacctggctcatgtccatcgatgtcaagtaccagatctggaagttcggggtcatcttcacagacaactccttcctgtacctgggctggtatatggtgatgtccctcttgggacactacaacaacttcttctttgctgcccatctcctggacatcgccatgggggtcaagacgctgcgcaccatcctgtcctctgtcacccacaatgggaaacagctggtgatgaccgtgggccttctggcggtggtcgtctacctgtacaccgtggtggccttcaacttcttccgcaagttctacaacaagagcgaggatgaggatgaacctgacatgaagtgtgatgacatgatgacgtgttacctgtttcacatgtacgtgggtgtccgggctggcggaggcattggggacgagatcgaggaccccgcgggtgacgaatacgagctctacagggtggtcttcgacatcaccttcttcttcttcgtcatcgtcatcctgttggccatcatccagggtctgatcatcgacgcttttggtgagctccgagaccaacaagagcaagtgaaggaggatatggagaccaagtgcttcatctgtggaatcggcagtgactactttgatacgacaccgcatggcttcgagactcacacgctggaggagcacaacctggccaattacatgtttttcctgatgtatttgataaacaaggatgagacagaacacacgggtcaggagtcttatgtctggaagatgtaccaagagagatgttgggatttcttcccagctggtgattgtttccgtaagcagtatgaggaccagcttagctgacacacccccagctggccctccacccccacctcaagtgccttattctcacagcaagccccttagtccccaagcccctccccctaaggcagctgggggagaggtgacctagtactggaaaataaatctgtgctacgccccccagca

SEQ ID NO: 32 - protein, 5033 aa, Homo sapiens
MGDAEGEDEVQFLRTDDEVVLQCSATVLKEQLKLCLAAEGFGNRLCFLEPTSNAQNVPPDLAICCFVLEQSLSVRALQEMLANTVEAGVESSQGGGHRTLLYGHAILLRHAHSRMYLSCLTTSRSMTDKLAFDVGLQEDATGEACWWTMHPASKQRSEGEKVRVGDDIILVSVSSERYLHLSTASGELQVDASFMQTLWNMNPICSRCEEGFVTGGHVLRLFHGHMDECLTISPADSDDQRRLVYYEGGAVCTHARSLWRLEPLRISWSGSHLRWGQPLRVRHVTTGQYLALTEDQGLVVVDASKAHTKATSFCFRISKEKLDVAPKRDVEGMGPPEIKYGESLCFVQHVASGLWLTYAAPDPKALRLGVLKKKAMLHQEGHMDDALSLTRCQQEESQAARMIHSTNGLYNQFIKSLDSFSGKPRGSGPPAGTALPIEGVILSLQDLIIYFEPPSEDLQHEEKQSKLRSLRNRQSLFQEEGMLSMVLNCIDRLNVYTTAAHFAEFAGEEAAESWKEIVNLLYELLASLIRGNRSNCALFSTNLDWLVSKLDRLEASSGILEVLYCVLIESPEVLNIIQENHIKSIISLLDKHGRNHKVLDVLCSLCVCNGVAVRSNQDLITENLLPGRELLLQTNLINYVTSIRPNIFVGRAEGTTQYSKWYFEVMVDEVTPFLTAQATHLRVGWALTEGYTPYPGAGEGWGGNGVGDDLYSYGFDGLHLWTGHVARPVTSPGQHLLAPEDVISCCLDLSVPSISFRINGCPVQGVFESFNLDGLFFPVVSFSAGVKVRFLLGGRHGEFKFLPPPGYAPCHEAVLPRERLHLEPIKEYRREGPRGPHLVGPSRCLSHTDFVPCPVDTVQIVLPPHLERIREKLAENIHELWALTRIEQGWTYGPVRDDNKRLHPCLVDFHSLPEPERNYNLQMSGETLKTLLALGCHVGMADEKAEDNLKKTKLPKTYMMSNGYKPAPLDLSHVRLTPAQTTLVDRLAENGHNVWARDRVGQGWSYSAVQDIPARRNPRLVPYRLLDEATKRSNRDSLCQAVRTLLGYGYNIEPPDQEPSQVENQSRCDRVRIFRAEKSYTVQSGRWYFEFEAVTTGEMRVGWARPELRPDVELGADELAYVFNGHRGQRWHLGSEPFGRPWQPGDVVGCMIDLTENTIIFTLNGEVLMSDSGSETAFREIEIGDGFLPVCSLGPGQVGHLNLGQDVSSLRFFAICGLQEGFEPFAINMQRPVTTWFSKGLPQFEPVPLEHPHYEVSRVDGTVDTPPCLRLTHRTWGSQNSLVEMLFLRLSLPVQFHQHFRCTAGATPLAPPGLQPPAEDEARAAEPDPDYENLRRSAGGWSEAENGKEGTAKEGAPGGTPQAGGEAQPARAENEKDATTEKNKKRGFLFKAKKVAMMTQPPATPTLPRLPHDVVPADNRDDPEIILNTTTYYYSVRVFAGQEPSCVWAGWVTPDYHQHDMSFDLSKVRVVTVTMGDEQGNVHSSLKCSNCYMVWGGDFVSPGQQGRISHTDLVIGCLVDLATGLMTFTANGKESNTFFQVEPNTKLFPAVFVLPTHQNVIQFELGKQKNIMPLSAAMFQSERKNPAPQCPPRLEMQMLMPVSWSRMPNHFLQVETRRAGERLGWAVQCQEPLTMMALHIPEENRCMDILELSERLDLQRFHSHTLRLYRAVCALGNNRVAHALCSHVDQAQLLHALEDAHLPGPLRAGYYDLLISIHLESACRSRRSMLSEYIVPLTPETRAITLFPPGRSTENGHPRHGLPGVGVTTSLRPPHHFSPPCFVAALPAAGAAEAPARLSPAIPLEALRDKALRMLGEAVRDGGQHARDPVGGSVEFQFVPVLKLVSTLLVMGIFGDEDVKQILKMIEPEVFTEEEEEEDEEEEGEEEDEEEKEEDEEETAQEKEDEEKEEEEAAEGEKEEGLEEGLLQMKLPESVKLQMCHLLEYFCDQELQHRVESLAAFAERYVDKLQANQRSRYGLLIKAFSMTAAETARRTREFRSPPQEQINMLLQFKDGTDEEDCPLPEEIRQDLLDFHQDLLAHCGIQLDGEEEEPEEETTLGSRLMSLLEKVRLVKKKEEKPEEERSAEESKPRSLQELVSHMVVRWAQEDFVQSPELVRAMFSLLHRQYDGLGELLRALPRAYTISPSSVEDTMSLLECLGQIRSLLIVQMGPQEENLMIQSIGNIMNNKVFYQHPNLMRALGMHETVMEVMVNVLGGGESKEIRFPKMVTSCCRFLCYFCRISRQNQRSMFDHLSYLLENSGIGLGMQGSTPLDVAAASVIDNNELALALQEQDLEKVVSYLAGCGLQSCPMLVAKGYPDIGWNPCGGERYLDFLRFAVFVNGESVEENANVVVRLLIRKPECFGPALRGEGGSGLLAAIEEAIRISEDPARDGPGIRRDRRREHFGEEPPEENRVHLGHAIMSFYAALIDLLGRCAPEMHLIQAGKGEALRIRAILRSLVPLEDLVGIISLPLQIPTLGKDGALVQPKMSASFVPDHKASMVLFLDRVYGIENQDFLLHVLDVGFLPDMRAAASLDTATFSTTEMALALNRYLCLAVLPLITKCAPLFAGTEHRAIMVDSMLHTVYRLSRGRSLTKAQRDVIEDCLMSLCRYIRPSMLQHLLRRLVFDVPILNEFAKMPLKLLTNHYERCWKYYCLPTGWANFGVTSEEELHLTRKLFWGIFDSLAHKKYDPELYRMAMPCLCAIAGALPPDYVDASYSSKAEKKATVDAEGNFDPRPVETLNVIIPEKLDSFINKFAEYTHEKWAFDKIQNNWSYGENIDEELKTHPMLRPYKTFSEKDKEIYRWPIKESLKAMIAWEWTIEKAREGEEEKTEKKKTRKISQSAQTYDPREGYNPQPPDLSAVTLSRELQAMAEQLAENYHNTWGRKKKQELEAKGGGTHPLLVPYDTLTAKEKARDREKAQELLKFLQMNGYAVTRGLKDMELDSSSIEKRFAFGFLQQLLRWMDISQEFIAHLEAVVSSGRVEKSPHEQEIKFFAKILLPLINQYFTNHCLYFLSTPAKVLGSGGHASNKEKEMITSLFCKLAALVRHRVSLFGTDAPAVVNCLHILARSLDARTVMKSGPEIVKAGLRSFFESASEDIEKMVENLRLGKVSQARTQVKGVGQNLTYTTVALLPVLTTLFQHIAQHQFGDDVILDDVQVSCYRTLCSIYSLGTTKNTYVEKLRPALGECLARLAAAMPVAFLEPQLNEYNACSVYTTKSPRERAILGLPNSVEEMCPDIPVLERLMADIGGLAESGARYTEMPHVIEITLPMLCSYLPRWWERGPEAPPSALPAGAPPPCTAVTSDHLNSLLGNILRIIVNNLGIDEASWMKRLAVFAQPIVSRARPELLQSHFIPTIGRLRKRAGKVVSEEEQLRLEAKAEAQEGELLVRDEFSVLCRDLYALYPLLIRYVDNNRAQWLTEPNPSAEELFRMVGEIFIYWSKSHNFKREEQNFVVQNEINNMSFLTADNKSKMAKSGGSDQERTKKKRRGDRYSVQTSLIVATLKKMLPIGLNMCAPTDQDLITLAKTRYALKDTDEEVREFLHNNLHLQGKVEGSPSLRWQMALYRGVPGREEDADDPEKIVRRVQEVSAVLYYLDQTEHPYKSKKAVWHKLLSKQRRRAVVACFRMTPLYNLPTHRACNMFLESYKAAWILTEDHSFEDRMIDDLSKAGEQEEEEEEVEEKKPDPLHQLVLHFSRTALTEKSKLDEDYLYMAYADIMAKSCHLEEGGENGEAEEEVEVSFEEKQMEKQRLLYQQARLHTRGAAEMVLQMISACKGETGAMVSSTLKLGISILNGGNAEVQQKMLDYLKDKKEVGFFQSIQALMQTCSVLDLNAFERQNKAEGLGMVNEDGTVINRQNGEKVMADDEFTQDLFRFLQLLCEGHNNDFQNYLRTQTGNTTTINIIICTVDYLLRLQESISDFYWYYSGKDVIEEQGKRNFSKAMSVAKQVFNSLTEYIQGPCTGNQQSLAHSRLWDAVVGFLHVFAHMMMKLAQDSSQIELLKELLDLQKDMVVMLLSLLEGNVVNGMIARQMVDMLVESSSNVEMILKFFDMFLKLKDIVGSEAFQDYVTDPRGLISKKDFQKAMDSQKQFSGPEIQFLLSCSEADENEMINCEEFANRFQEPARDIGFNVAVLLTNLSEHVPHDPRLHNFLELAESILEYFRPYLGRIEIMGASRRIERIYFEISETNRAQWEMPQVKESKRQFIFDVVNEGGEAEKMELFVSFCEDTIFEMQIAAQISEPEGEPETDEDEGAGAAEAGAEGAEEGAAGLEGTAATAAAGATARVVAAAGRALRGLSYRSLRRRVRRLRRLTAREAATAVAALLWAAVTRAGAAGAGAAAGALGLLWGSLFGGGLVEGAKKVTVTELLAGMPDPTSDEVHGEQPAGPGGDADGEGASEGAGDAAEGAGDEEEAVHEAGPGGADGAVAVTDGGPFRPEGAGGLGDMGDTTPAEPPTPEGSPILKRKLGVDGVEEELPPEPEPEPEPELEPEKADAENGEKEEVPEPTPEPPKKQAPPSPPPKKEEAGGEFWGELEVQRVKFLNYLSRNFYTLRFLALFLAFAINFILLFYKVSDSPPGEDDMEGSAAGDVSGAGSGGSSGWGLGAGEEAEGDEDENMVYYFLEESTGYMEPALRCLSLLHTLVAFLCIIGYNCLKVPLVIFKREKELARKLEFDGLYITEQPEDDDVKGQWDRLVLNTPSFPSNYWDKFVKRKVLDKHGDIYGRERIAELLGMDLATLEITAHNERKPNPPPGLLTWLMSIDVKYQIWKFGVIFTDNSFLYLGWYMVMSLLGHYNNFFFAAHLLDIAMGVKTLRTILSSVTHNGKQLVMTVGLLAVVVYLYTVVAFNFFRKFYNKSEDEDEPDMKCDDMMTCYLFHMYVGVRAGGGIGDEIEDPAGDEYELYRVVFDITFFFFVIVILLAIIQGLIIDAFGELRDQQEQVKEDMETKCFICGIGSDYFDTTPHGFETHTLEEHNLANYMFFLMYLINKDETEHTGQESYVWKMYQERCWDFFPAGDCFRKQYEDQLS

SEQ ID NO: 33 - DNA, 5989 bp, Homo sapiens
gcgtcccgggtccccgcgccgcgccgcgacctgcagaccccgccgccgcgctcgggcccgtctcccacgcccccgccgccccgcgcgcccaactccgccggccgccccgccccgccccgcgcgctccagacccccggggcggctgccgggagagatgctggaagaaacttcttaaatgaccgcgtctggctggccgtggagcctttctgggttggggagaggaaaggaaagtggaaaaaacctgagaacttcctgatctctctcgctgtgagacatgtctgagactcctgctcagtgtagcattaagcaggaacgaatttcatatacacctccagagagcccagtgccgagttacgcttcctcgacgccacttcatgttccagtgcctcgagcgctcaggatggaggaagactcgatccgcctgcctgcgcacctgcgcttgcagccaatttactggagcagggatgacgtagcccagtggctcaagtgggctgaaaatgagttttctttaaggccaattgacagcaacacgtttgaaatgaatggcaaagctctcctgctgctgaccaaagaggactttcgctatcgatctcctcattcaggtgatgtgctctatgaactccttcagcatattctgaagcagaggaaacctcggattcttttttcaccattcttccaccctggaaactctatacacacacagccggaggtcatactgcatcagaaccatgaagaagataactgtgtccagaggacccccaggccatccgtggataatgtgcaccataaccctcccaccattgaactgttgcaccgctccaggtcacctatcacgacaaatcaccggccttctcctgaccccgagcagcggcccctccggtcccccctggacaacatgatccgccgcctctccccggctgagagagctcagggacccaggccgcaccaggagaacaaccaccaggagtcctaccctctgtcagtgtctcccatggagaataatcactgcccagcgtcctccgagtcccacccgaagccatccagcccccggcaggagagcacacgcgtgatccagctgatgcccagccccatcatgcaccctctgatcctgaacccccggcactccgtggatttcaaacagtccaggctctccgaggacgggctgcatagggaagggaagcccatcaacctctctcatcgggaagacctggcttacatgaaccacatcatggtctctgtctccccgcctgaagagcacgccatgcccattgggagaatagcagactgtagactgctttgggattacgtctatcagttgctttctgacagccggtacgaaaacttcatccgatgggaggacaaagaatccaaaatattccggatagtggatcccaacggactggctcgactgtggggaaaccataagaacagaacaaacatgacctatgagaaaatgtccagagccctgcgccactactacaaactaaacattatcaggaaggagccaggacaaaggcttttgttcaggtttatgaaaaccccagatgaaatcatgagtggccgaacagaccgtctggagcacctagagtcccaggagctggatgaacaaatataccaagaagatgaatgctgaaggaaccaacagtccacctcagcgggccagcagcccagggaacccctgcccaccaggattgctggaagtgtgacggagcaggcgggctgaggagagtggaaaaggaagcgacccagaaatggcagggacacttctcttgcagaccaagagggaccctggagcaccttagacaaactacccagcacaggcggggctggaattctggcggagggcatgagcctgggactccatgtcacgtttccttctgatttggaatctctccatctgtaattcctcaccctcacccttccaccgttgttagtatcatggtgtttttgtttttgtttttgttttaagaacctgcagtttgactcttcatcgttcatctaggggaagacatctgatgttgttttcctatggaaatatatatctattatatatatattttttgcaaatctcacaaagtgcggcaagcccagctggtcaggaaagagaatacttgcagaggggttcaggttcctctttttcctgccacgtggatcaggtctgttcctgttactgttgggtcttggctgaaaaaaaaaaatgcttttaaaaaagataaaatgaaaaggagagctctctttttctctctcttgctctgttcttcccttggtcccctctgtcctcccgccctgcctgcagttgagattcagatgccttctgacagagttcagcctcttggagagtcttggggattgttggcacctaaacagaatcagtgacccgggtgctttgtggccagcagcacagaatcaaacccgcatcccagcattgggccacccatctgagggaggccaaaatcatcacagatgctgctgtgctgcagacagatacatgctagtccagagagccgcccctgagatggctgtgagaaccatgtgtctaaggcgtaagataaggatggaaggctgtccaagttatttggaaggcctcggcagcttgggattagcttgggagcgcagcgctgcaaagtggaaaatatgaaaagaccacacaggcccagcagtccagaaactgggcaaaaatattctgcagtggggatttatttttccaaagcaggtaacagaggctagtgagaaagaaaagctcctctctgctccattccaaaggccatcttgtggtcagtttcatgccctcacctgatttttttttttttttttttttttcaattcctaaccttttttaaagtttcctggtctccactggacacagagctttggagacggaggatcccagagggcagtctcagttgcaatcagtgtgtgcccagcctgggcagacaggaaattcctcggatacattattttttctttctttcatagctgtgtctcagaaaggacccatttgtggctctttttcacctcaaaataagatcgatggtatcttgtaaaatgagggtagtgccacttcttagtatttttgaaagctgttttagattttttttttttttccttttctagccatctaaattgactcttccaatataggtctcagaaatccaatatttggagtacaatttcttttaatccagattacacctgccttacaaagcaccccctccttgttcccctctgtttcctctactcagttgggggagaaactcacagctcctccgggatacatatgtgccctcagcagcagctcccaggtgaagttaccagacccctgggcttctccccagctttttctgagttgagtcagacatgtagagtttgggtcacacaggcaagaggaattttccctcggccttactgacaaggacaccaacctagggtgcaaacagatggactatggttcaaggacactggaattgaggagctgatcaaggctctcttcagccttgctctgtccctgcctcttatcagagcacaggtagacacacgggcatagccagcccactcctactgtcacaggcgccccaccattcaaccttccgggaggtcagggaccttctatatgaggcgagtgggtctcagtctgcttgaatggtgatgagattctgctggatctcagcacgctgcaggtgtcttttgagagcattcagtaggacatggtgatccctatttcagcctctaagatgactggtattctatctgaaatgcagagattaagccaaatacctgatgtattgtgaaagccactgattttaagaatggagagaaagggattttttactgcatccctctgtatgaatatgaaatcagagaccagggcatgatgttgctaggattagagcctctcagtctggcctcttcacccaagtgcaagaactcagtctcttactgttcaaagaatcttaacagttgaattatggagggaaattcccttttgccccaagcatttctatatttaaagcaatatcccaggagaatatgttagacttaggatgataccttcagccacttgaagaagaaatagaaggcgctcattccaatatagtctttatttcccattcagatacaggttgagcatccctaatctgaacagttaaaacccccaaatgccccaaaatccaaaccttcctgaacgctatgacaccatgagtggaaaattccacacctaacaaacacatttgctttcttatggttcaatgtacacaaactgttttatatagaaaatgatttcaaatatcataaaattaccttcaggctatgtgtataaagtatatatgagccataaatgaattttgtgtttagactttgtgtccatccccaagatctctcattttatatatatatatatatatatatatatatatatatatatatatatatacacacacacacacatacacaaatattccaggatacaaaaaaaaacatttaaaaatccgagacccagaacacttctggtcccaagcatttcagataagggatatcaatctgtactaccaataaggatttcgtaattcccctaactgcaaatgtcctcttcatttgttctttatgagaaaacccgggtagtgccagcacctggatacagtatttacaccctgcagaccctaaagatttcagattcagttagcaaaccttgatgaagcacctgctggacactgagggacccaaagctcaatcagccataatccctgctttcagagtttatattgtacctgcctaatccacccggcgtgactcatttcaacactaagtactaggggtgttgtcaggagacaaatctgaagtcaggagaggaaaatgcaaaggagccctgccgtgtgatggatgtgcattctcacttgggtcttgaagttctcattcctacatctcaagctagccaggcagtctcctctctatcagaagaaagcactggtaattggctagactggctatgttgaaggtaacatgaactctaagatcttgacccagggcgacttggttttgcttaaggtggcatcaccaatgttccaaatcctttagggagatgagggtatccccacagaaaaagaggaataatagaccaatggattttctcctttcaccagtatgtttggaaccctctgatccaatgtcttttgatactgatctcttgtccaaatgagaatgtcgctttagctgaaattcaaatggctgtgacaatttaccgaaatgatgaagtaaccaccattcccacctttcactgcctaggctccaagtctgaatacatttttgaaataggaactcccttttgcaaaaaagaaacctgggtgtcagggaggtgaagtgacttgccctaggagcagacagcatgccaagaatggaattaggctcaggatccagcctgggctcaccctgtgtggctcattcccacccaggaaactgaagataaaagatttgggaaaacacaccaagaaaaaggggcagttttctttgcccaagcatttggtgctagttagaggctgttcactctctcctgctcctcttcggagtagaaataaaggctgtgacacaaggaagccagtggggtgggagggaggcaccataatccctccctaaaacccacagaagactaacctgatactcttttgacccaactgcatcaacactaaacagctgcagaccccctgaatctttcacacatgccaagtgaacattcttgatgatttctctttgtgaccgcaaccacctgcaaaccagaacgactctagaatttccttccccgcccccctttttgtttagtttctaatctcttgtttatgaggtgtggggtttataagggactgaatcaaatgaatgtaacaaaaaagaaaaaaaaaacaaaaaaaaatgccttttctcagggccagtgagttgcaaataatttttaaagaaaagcctataattacatcatctcaataaattttttataaaaaaaaaaaaa

SEQ ID NO: 34 - protein, 452 aa, Homo sapiens
MSETPAQCSIKQERISYTPPESPVPSYASSTPLHVPVPRALRMEEDSIRLPAHLRLQPIYWSRDDVAQWLKWAENEFSLRPIDSNTFEMNGKALLLLTKEDFRYRSPHSGDVLYELLQHILKQRKPRILFSPFFHPGNSIHTQPEVILHQNHEEDNCVQRTPRPSVDNVHHNPPTIELLHRSRSPITTNHRPSPDPEQRPLRSPLDNMIRRLSPAERAQGPRPHQENNHQESYPLSVSPMENNHCPASSESHPKPSSPRQESTRVIQLMPSPIMHPLILNPRHSVDFKQSRLSEDGLHREGKPINLSHREDLAYMNHIMVSVSPPEEHAMPIGRIADCRLLWDYVYQLLSDSRYENFIRWEDKESKIFRIVDPNGLARLWGNHKNRTNMTYEKMSRALRHYYKLNIIRKEPGQRLLFRFMKTPDEIMSGRTDRLEHLESQELDEQIYQEDEC

SEQ ID NO: 35 - DNA, 2658 bp, Homo sapiens
aataaatatccgtgtagaaaatcagaacgactctttcaggccatctttaaaatgtcattggtaaaccatacttgatcctaaattcctgtacttcctcaggccatccgagcatgaaacgctgtcacctacccacatccgctggctgtgacgcttgtcaaagtgttctctatcggctgcatgcctagaccaccaaagcgttctgaccggacagtgtcactggagaaggcggcgcgacatgtccagggcgcagatctgggctctggtgtctggtgtcggagggtttggagctctcgttgctgctaccacgtccaatgagtggaaagtgaccacgcgagcctcctcggtgataacagccacttgggtttaccagggtctgtggatgaactgcgcaggtaacgcgttgggttctttccattgccgaccgcattttactatcttcaaagtagcaggttatatacaggcatgtagaggacttatgatcgctgctgtcagcctgggcttctttggttccatatttgcgctctttggaatgaagtgtaccaaagtcggaggctccgataaagccaaagctaaaattgcttgtttggctgggattgtattcatactgtcagggctgtgctcaatgactggatgttccctatatgcaaacaaaatcacaacggaattctttgatcctctctttgttgagcaaaagtatgaattaggagccgctctgtttattggatgggcaggagcctcactgtgcataattggtggtgtcatattttgcttttcaatatctgacaacaacaaaacacccagatacacatacaacggggccacatctgtcatgtcttctcggacaaagtatcatggtggagaagattttaaaacaacaaacccttcaaaacagtttgataaaaatgcttatgtctaaaagagctcgctggcaagctgcctcttgagtttgttataaaagcgaactgttcacaaaatgatcccatcaaggccctcccataattaacactcaaaactatttttaaaatatgcatttgaagcatctgttgattgtatggatgtaagtgttcttacatagttagttatatactaatcattttctgttgtggctttctataaaaaataaacagtttatttacaggatttgtaaaatgttttctacatttatatagaacatgaaaagcatttagtaccaaaggttcaagaagtattcgtactctagcctttttaatcattcatagatagaagtctttgtacccactccttatgtttcttttcattcataaacaggtgtataaggaacaatgtcttataaacagcatgggggcaatctgagaatattcctcaaaaggtgtccaggttaaatagacatgttactggctgcacacaggcaaattctagtttgttttttttaagtattctacaacatttatttaaaaaggtaaatctttttgttgaagcagcaagttatctggtagaacttaacttctacaggatcagagaggatcttgctcattcatggccatatccacatgcccatggccactcagtagattgttgaaaaagcaaagccacaccattctctttgatgtatgcagagagttacgtagcaggggatgttctctgatttattccactggcaccattagtgaatatttagttgttttcataaacgatgctgtgatgaagactcatgtacatatttagcaaattttggtttcttacatgtgcctgtcatgactgtaattcattatgactgctccaggaagggctaatggggccaatatattattgcctgtcatgtggcacatccatgttaaggggctgaggcgtccctggcacggaatgcagagccctgagctagggcatcagcagaagctgagatagagatattggtcatggttgactgaggagccaattaaaacctgtttatgcctagtgttccattattggaacactaagcatgtgggagttatttatatcctactgctcaaggtcatcgccaaggtgtgattggaaaaattcaaaaaattgcaacctcaggcataaatgggttaaggacatcccaagcccaagtggtacgtgcctcactcagaactgacgggccgagttctatctaggtgtgtcttccagaacctgtttacggctaactggataactgagagacttgtcatttctaaagacatttaagttgctccagggatttctgaaaaaagacacaggcttcttcctagagccagccctatataacatgcccacaagggcaacagttatcacagttcatacacacctttcatgtcctgtctcactcactcctcacagccatcctaggagatacatattgttttcatcctgcatttacagaaaaagaaatgaaaacagagagcttaaataatttgccacagtaatgtcgaaactaggcctttgaaccaaggcagtctagggtaaaatatagtttcaaagtatgaataagaattggtatttgtgttatctttgagtaagaaactgtccgatatgaatcacaacgtgggtgaatgtagtattttcctgaagtgtgaaagacttaaaaaaaagaatcacattgttcagaggtgctcaatggaaagaaaaggaaatgaacaagtttgttaaaagataaaaaataaaaaaaattccatacct

SEQ ID NO: 36 - protein, 226 aa, Homo sapiens
MSRAQIWALVSGVGGFGALVAATTSNEWKVTTRASSVITATWVYQGLWMNCAGNALGSFHCRPHFTIFKVAGYIQACRGLMIAAVSLGFFGSIFALFGMKCTKVGGSDKAKAKIACLAGIVFILSGLCSMTGCSLYANKITTEFFDPLFVEQKYELGAALFIGWAGASLCIIGGVIFCFSISDNNKTPRYTYNGATSVMSSRTKYHGGEDFKTTNPSKQFDKNAYV

SEQ ID NO: 37 - DNA, 2601 bp, Homo sapiens
aataaatatccgtgtagaaaatcagaacgactctttcaggccatctttaaaatgtcattggtaaaccatacttgatcctaaattcctgtacttcctcaggccatccgagcatgaaacgctgtcacctacccacatccgctggctgtgacgcttgtcaaagtgttctctatcggctgcatgcctagaccaccaaagcgttctgaccggacagtgtcactggagaaggcggcgcgacatgtccagggcgcagatctgggctctggtgtctggtgtcggagggtttggagctctcgttgctgctaccacgtccaatgagtggaaagtgaccacgcgagcctcctcggtgataacagccacttgggtttaccagggtctgtggatgaactgcgcaggttatatacaggcatgtagaggacttatgatcgctgctgtcagcctgggcttctttggttccatatttgcgctctttggaatgaagtgtaccaaagtcggaggctccgataaagccaaagctaaaattgcttgtttggctgggattgtattcatactgtcagggctgtgctcaatgactggatgttccctatatgcaaacaaaatcacaacggaattctttgatcctctctttgttgagcaaaagtatgaattaggagccgctctgtttattggatgggcaggagcctcactgtgcataattggtggtgtcatattttgcttttcaatatctgacaacaacaaaacacccagatacacatacaacggggccacatctgtcatgtcttctcggacaaagtatcatggtggagaagattttaaaacaacaaacccttcaaaacagtttgataaaaatgcttatgtctaaaagagctcgctggcaagctgcctcttgagtttgttataaaagcgaactgttcacaaaatgatcccatcaaggccctcccataattaacactcaaaactatttttaaaatatgcatttgaagcatctgttgattgtatggatgtaagtgttcttacatagttagttatatactaatcattttctgttgtggctttctataaaaaataaacagtttatttacaggatttgtaaaatgttttctacatttatatagaacatgaaaagcatttagtaccaaaggttcaagaagtattcgtactctagcctttttaatcattcatagatagaagtctttgtacccactccttatgtttcttttcattcataaacaggtgtataaggaacaatgtcttataaacagcatgggggcaatctgagaatattcctcaaaaggtgtccaggttaaatagacatgttactggctgcacacaggcaaattctagtttgttttttttaagtattctacaacatttatttaaaaaggtaaatctttttgttgaagcagcaagttatctggtagaacttaacttctacaggatcagagaggatcttgctcattcatggccatatccacatgcccatggccactcagtagattgttgaaaaagcaaagccacaccattctctttgatgtatgcagagagttacgtagcaggggatgttctctgatttattccactggcaccattagtgaatatttagttgttttcataaacgatgctgtgatgaagactcatgtacatatttagcaaattttggtttcttacatgtgcctgtcatgactgtaattcattatgactgctccaggaagggctaatggggccaatatattattgcctgtcatgtggcacatccatgttaaggggctgaggcgtccctggcacggaatgcagagccctgagctagggcatcagcagaagctgagatagagatattggtcatggttgactgaggagccaattaaaacctgtttatgcctagtgttccattattggaacactaagcatgtgggagttatttatatcctactgctcaaggtcatcgccaaggtgtgattggaaaaattcaaaaaattgcaacctcaggcataaatgggttaaggacatcccaagcccaagtggtacgtgcctcactcagaactgacgggccgagttctatctaggtgtgtcttccagaacctgtttacggctaactggataactgagagacttgtcatttctaaagacatttaagttgctccagggatttctgaaaaaagacacaggcttcttcctagagccagccctatataacatgcccacaagggcaacagttatcacagttcatacacacctttcatgtcctgtctcactcactcctcacagccatcctaggagatacatattgttttcatcctgcatttacagaaaaagaaatgaaaacagagagcttaaataatttgccacagtaatgtcgaaactaggcctttgaaccaaggcagtctagggtaaaatatagtttcaaagtatgaataagaattggtatttgtgttatctttgagtaagaaactgtccgatatgaatcacaacgtgggtgaatgtagtattttcctgaagtgtgaaagacttaaaaaaaagaatcacattgttcagaggtgctcaatggaaagaaaaggaaatgaacaagtttgttaaaagataaaaaataaaaaaaattccatacct

SEQ ID NO: 38 - protein, 207 aa, Homo sapiens
MSRAQIWALVSGVGGFGALVAATTSNEWKVTTRASSVITATWVYQGLWMNCAGYIQACRGLMIAAVSLGFFGSIFALFGMKCTKVGGSDKAKAKIACLAGIVFILSGLCSMTGCSLYANKITTEFFDPLFVEQKYELGAALFIGWAGASLCIIGGVIFCFSISDNNKTPRYTYNGATSVMSSRTKYHGGEDFKTTNPSKQFDKNAYV

SEQ ID NO: 39 - DNA, 2490 bp, Homo sapiens
gagtgcgggggtcgcggcgcagagtgggagccggagagcgagcgcggctgcagccggcggcatggctagcacggcttcggagatcatcgccttcatggtctccatctcaggctgggtactggtgtcctccacgctgcccaccgactactggaaggtgtctaccatcgacggcacggtcatcacaaccgccacctattgggccaacctgtggaaggcgtgcgttaccgactccacgggcgtctccaactgcaaggacttcccctccatgctggcgctggacggttatatacaggcatgtagaggacttatgatcgctgctgtcagcctgggcttctttggttccatatttgcgctctttggaatgaagtgtaccaaagtcggaggctccgataaagccaaagctaaaattgcttgtttggctgggattgtattcatactgtcagggctgtgctcaatgactggatgttccctatatgcaaacaaaatcacaacggaattctttgatcctctctttgttgagcaaaagtatgaattaggagccgctctgtttattggatgggcaggagcctcactgtgcataattggtggtgtcatattttgcttttcaatatctgacaacaacaaaacacccagatacacatacaacggggccacatctgtcatgtcttctcggacaaagtatcatggtggagaagattttaaaacaacaaacccttcaaaacagtttgataaaaatgcttatgtctaaaagagctcgctggcaagctgcctcttgagtttgttataaaagcgaactgttcacaaaatgatcccatcaaggccctcccataattaacactcaaaactatttttaaaatatgcatttgaagcatctgttgattgtatggatgtaagtgttcttacatagttagttatatactaatcattttctgttgtggctttctataaaaaataaacagtttatttacaggatttgtaaaatgttttctacatttatatagaacatgaaaagcatttagtaccaaaggttcaagaagtattcgtactctagcctttttaatcattcatagatagaagtctttgtacccactccttatgtttcttttcattcataaacaggtgtataaggaacaatgtcttataaacagcatgggggcaatctgagaatattcctcaaaaggtgtccaggttaaatagacatgttactggctgcacacaggcaaattctagtttgttttttttaagtattctacaacatttatttaaaaaggtaaatctttttgttgaagcagcaagttatctggtagaacttaacttctacaggatcagagaggatcttgctcattcatggccatatccacatgcccatggccactcagtagattgttgaaaaagcaaagccacaccattctctttgatgtatgcagagagttacgtagcaggggatgttctctgatttattccactggcaccattagtgaatatttagttgttttcataaacgatgctgtgatgaagactcatgtacatatttagcaaattttggtttcttacatgtgcctgtcatgactgtaattcattatgactgctccaggaagggctaatggggccaatatattattgcctgtcatgtggcacatccatgttaaggggctgaggcgtccctggcacggaatgcagagccctgagctagggcatcagcagaagctgagatagagatattggtcatggttgactgaggagccaattaaaacctgtttatgcctagtgttccattattggaacactaagcatgtgggagttatttatatcctactgctcaaggtcatcgccaaggtgtgattggaaaaattcaaaaaattgcaacctcaggcataaatgggttaaggacatcccaagcccaagtggtacgtgcctcactcagaactgacgggccgagttctatctaggtgtgtcttccagaacctgtttacggctaactggataactgagagacttgtcatttctaaagacatttaagttgctccagggatttctgaaaaaagacacaggcttcttcctagagccagccctatataacatgcccacaagggcaacagttatcacagttcatacacacctttcatgtcctgtctcactcactcctcacagccatcctaggagatacatattgttttcatcctgcatttacagaaaaagaaatgaaaacagagagcttaaataatttgccacagtaatgtcgaaactaggcctttgaaccaaggcagtctagggtaaaatatagtttcaaagtatgaataagaattggtatttgtgttatctttgagtaagaaactgtccgatatgaatcacaacgtgggtgaatgtagtattttcctgaagtgtgaaagacttaaaaaaaagaatcacattgttcagaggtgctcaatggaaagaaaaggaaatgaacaagtttgttaaaagataaaaaataaaaaaaattccatacct

SEQ ID NO: 40 - protein, 228 aa, Homo sapiens
MASTASEIIAFMVSISGWVLVSSTLPTDYWKVSTIDGTVITTATYWANLWKACVTDSTGVSNCKDFPSMLALDGYIQACRGLMIAAVSLGFFGSIFALFGMKCTKVGGSDKAKAKIACLAGIVFILSGLCSMTGCSLYANKITTEFFDPLFVEQKYELGAALFIGWAGASLCIIGGVIFCFSISDNNKTPRYTYNGATSVMSSRTKYHGGEDFKTTNPSKQFDKNAYV

SEQ ID NO: 41 - DNA, 3271 bp, Homo sapiens
cggaggtgagtgcagggctccgggcgctgtgtgccgtgccctgtcccccaggctctgggtccggttgagacgcactcccaccctgggtgctgcagggtctcccgtggcctacgctgccaggaggcccaggctgggagagggagcagggcggcggcccggggtgctcttccgcgctcctcgactccagctttggtctttgtggctcaatagcttgcgcccattggaaggggaaacgcacgttgctgtcccagccacgaggccctgagcatttagcacttggtcgacgggggaagatgtgtcggtgcagctaaaagatggaatatttgcgggcgtgaagcggcccgaggtgataccacaagtcttttgacatgctgaggtctggcaggaacattaacctatgtgcatcccgagtatggaccgtgtgctcccaggctcctgacatagggtcatgaattagggccgagtgggagcgcagagcccctcccagtcacccggcagcagaagcagcccggcttttggaggacattgtctcctggagcagtgtcagtcccaaaagctccagcccttctctgagacggggaccaggggatggcagccatgcacctgacagcctggccccagggacttcacggatcccctgaagctcatccatggacttccatggactacagggcctgagctatggaattggccctagggcagcaggaacctattgtttcagaagtcggtgacctttgaggacgtggctgtgtacttcacccaggcggaatgggatggcctgtcccctgcacagaggaccctgtacagggatgtgatgctggagaattatgggaatgtggcctccctgggatttccacttctcaaacctgctgtgatctcacaactggagggaggaagtgagctggggggctcatctccactggctgcaggaacaggcctccagggcctccagactgatattcagactgacaatgatttgacaaaggaaatgtatgaaggaaaagagaatgtatcatttgaacttcaaagagacttttcccaggaaacagacttttcagaagcctctcttctagagaaacaacaggaagtccactcagcaggaaatataaagaaggagaagagcaacaccattgatggaacagtgaaagatgagacaagccccgtggaggagtgtttttttagtcaaagttcaaactcatatcagtgtcataccatcactggagagcagccctctgggtgtacaggattggggaaatccatcagctttgatacaaaactcgtgaagcatgaaataattaattctgaggaaagacctttcaaatgtgaagaattagtagagccctttaggtgtgactctcaacttattcaacatcaagagaacaacactgaggaaaagccttatcagtgttcggagtgtggcaaagctttcagcattaatgagaaattaatttggcatcagagacttcacagtggggagaaacccttcaaatgtgtggagtgtgggaaaagcttcagctacagttcccattatatcacacatcagacaatccacagtggggagaagccctatcagtgtaagatgtgtgggaaggccttcagtgttaatggaagcctaagtaggcatcagagaatccatacgggagagaagccctatcagtgcaaggaatgtggaaatggcttcagctgtagttctgcatatattacacatcagagagtccacactggagagaaaccttacgagtgtaatgactgtgggaaagcgttcaatgttaatgcaaaattaattcaacatcagagaatccatactggagagaaaccttatgaatgtaatgaatgtggaaaaggcttcaggtgcagctcccagcttaggcagcatcagagcatccacacaggagaaaagccctatcagtgtaaagagtgtggaaaaggcttcaataataatacaaaactcattcagcatcagagaatccacacaggtgagaaaccctatgaatgcactgaatgtggaaaagccttcagtgtcaaagggaagttaatccaacaccagagaattcacacaggcgagaaaccctatgagtgtaatgaatgcgggaaagccttcagatgtaactcccaatttcggcagcatctgagaattcacactggggagaagccctatgagtgtaatgagtgtggaaaggccttcagcgttaatgggaaactaatgcggcatcagagaattcacactggggagaaaccttttgaatgtaatgagtgtgggagatgctttacttctaaaagaaacctacttgatcatcaccgaatccatactggagaaaagccctatcaatgtaaggaatgtgggaaagccttcagtatcaatgccaaactaactaggcatcagaggatacatactggggagaaacctttcaaatgtatggaatgtgagaaagcattcagctgtagttctaactatattgtgcaccagagaatccatacaggagagaaaccctttcagtgtaaggagtgtggaaaagccttccatgttaatgcccatttaattcggcatcagagaagccacactggggagaaacccttcagatgtgtggaatgtggcaaaggcttcagctttagttctgactacattatacatcagacagtccacacttggaagaaaccctatatgtgtagtgtgtgtgggaaagcattcaggtttagcttccagctcagtcagcatcagagtgtccatagtgaaggaaaatcctaataatgagaaagatacagaaaactcttaaggttaatgccaaaatggatcaagtatcatcagattcatccattgaaaaacctccaagagggcatgaatatggcagagtcttcatatggaaacagtttttattctattcagtttaaatcaggaaaggatgaccagttaaagagaaacatccaaaaatagctttgttttgtaccaacaggaattagaaaatataatgaaaagatttcgttcccagcagcatcaagaaaagtagattttctagaaataaacagttatggaggacttgtatggagaaatttaagtcttcactgagggccactttacaaaggaaatttgaataaatggagagagagagaagccttgttgttggataggaaaacccgtactaaagatactctacctacattaatttatttgtttaatttttgacaacaagcatgtattacttttgaaaagatgaaaaataaagatttatttaaaaaaggaaaaaaaaaaaaaaaaaaaaaaaaaaaaaaaaac

SEQ ID NO: 42 - protein, 643 aa, Homo sapiens
MLENYGNVASLGFPLLKPAVISQLEGGSELGGSSPLAAGTGLQGLQTDIQTDNDLTKEMYEGKENVSFELQRDFSQETDFSEASLLEKQQEVHSAGNIKKEKSNTIDGTVKDETSPVEECFFSQSSNSYQCHTITGEQPSGCTGLGKSISFDTKLVKHEIINSEERPFKCEELVEPFRCDSQLIQHQENNTEEKPYQCSECGKAFSINEKLIWHQRLHSGEKPFKCVECGKSFSYSSHYITHQTIHSGEKPYQCKMCGKAFSVNGSLSRHQRIHTGEKPYQCKECGNGFSCSSAYITHQRVHTGEKPYECNDCGKAFNVNAKLIQHQRIHTGEKPYECNECGKGFRCSSQLRQHQSIHTGEKPYQCKECGKGFNNNTKLIQHQRIHTGEKPYECTECGKAFSVKGKLIQHQRIHTGEKPYECNECGKAFRCNSQFRQHLRIHTGEKPYECNECGKAFSVNGKLMRHQRIHTGEKPFECNECGRCFTSKRNLLDHHRIHTGEKPYQCKECGKAFSINAKLTRHQRIHTGEKPFKCMECEKAFSCSSNYIVHQRIHTGEKPFQCKECGKAFHVNAHLIRHQRSHTGEKPFRCVECGKGFSFSSDYIIHQTVHTWKKPYMCSVCGKAFRFSFQLSQHQSVHSEGKS

SEQ ID NO: 43 - DNA, 5583 bp, Homo sapiens
atgggagcgggatcggcgcggggggcccgaggcacagcggcggcggcggcggcgcgcgggggggggtttctcttctcctggatcttagtctcgtttgcctgtcacctggcctccacccaaggagctcctgaagatgtggacatcctccagcggctgggcctcagctggacgaaggccgggagccctgcacccccgggagtcattcctttccagtcgggcttcatctttacgcagcgggcccggctccaggctcccacgggcaccgtcattcctgccgccttgggcacagagctggcactggtgctgagcctctgctcccaccgggtgaaccatgccttcctcttcgctgtccgcagccagaaacgcaagctgcagctgggcctgcagttcctccccggcaagacggtcgtccacctcgggtcccggcgctcagtggccttcgacctcgacatgcacgacgggcgctggcaccacctggccctcgagctccgaggccgcacagtcactctggtgactgcctgcgggcagcgccgggtgcctgtcctgctgcctttccacagggaccctgcactcgaccctgggggctccttcctctttgggaagatgaacccgcatgcagtccagtttgaaggtgctctctgccagttcagtatctaccctgtgacgcaggtcgctcacaattactgtacccacctgaggaagcagtgtggacaggctgacacgtaccagtccccactgggacctctcttctcccaagactctggcagaccttttaccttccagtccgacctcgccctgctaggcctggagaacttgaccactgccacaccagccctggggtcactgccagcaggcaggggacccagggggactgtggcacccgccacgcccaccaagccccaaaggactagccccacaaaccctcaccagcatatggcggtgggaggcccagcccaaaccccgctgctacctgccaagctgtcagccagtaacgcacttgatcccatgctcccagcctctgttggcggctctaccagaacgcctcgccctgcggccgctcaaccatcacagaagatcacagccaccaaaatccccaaaagcctccctaccaagccttcggccccttctacttcaattgtgcccatcaaaagcccccatcctacccagaaaacagctccatcttcatttacaaagtcagccctacccactcagaagcaagtgccacctacttcccgtccagttcctgccagagtctcccgtcccgcagagaagcccatccagaggaacccgggaatgcccaggcccccaccgcccagcacccggcccctacctcctaccaccagctcctctaaaaaacccattcccacactagctcggactgaggccaagataaccagccatgccagtaagccggcctctgcccgcaccagcacccacaaacctcccccatttactgctttatcctcatctcctgcccctactcctggttctaccaggagtactcggccaccagccacgatggtacctccaacttcgggcaccagcactcccagaacagcacctgccgtccccactcctggctcagctcccactggaagcaagaagcccattggatcggaagcctcaaagaaagccggacccaagagcagcccccggaagcctgtccccctcagacctgggaaggcagccagggatgtccccttgagcgatctgacaaccaggcctagccccagacagccccagcccagtcagcagaccaccccggccctggtattggccccggcgcaattcctgtcctccagcccccggcccacgagcagtggctattcgatcttccacctggcaggatctacgcctttccctctgctgatggggcctccgggacccaagggagactgtggcttgccgggtccccctgggctacctgggctacctggaatccctggtgcacgtgggcctcggggtcctcctgggccttatggaaatccaggtctccccggccctcctggagccaaaggacagaaaggggacccagggctctcaccaggaaaggcccacgatggggcaaagggtgacatgggcttgcctgggctctccgggaatccaggacctccgggacgaaagggacacaagggctatcctggaccggcagggcaccccggagaacaggggcagccaggacctgagggcagcccaggggccaaaggttaccctggcaggcaggggttacctggaccggtaggagatcccggccccaaaggcagcaggggctacattgggctcccagggctcttcggcctgccagggtctgatggagaacgaggcctgcctggcgttcctggcaagaggggcaagatgggtatgccggggtttcctggagtctttggggaaagaggccctcctggactggatggaaatcctggagaactgggcctgccaggcccccctggagtccccggcctcattggtgacttaggagtgttgggtccgattggctacccgggacccaagggcatgaagggactgatgggcagcgtgggggagcccggactgaaaggtgataagggtgaacaaggggttccaggtgtgtcaggagatcccggattccaaggagacaaggggagccaggggttgccagggttccccggtgcacgggggaagccagggcctctgggcaaagtcggagacaaaggatccattgggtttcccgggccccctggacccgagggattcccaggagacatcggcccccctggcgacaatggcccagaaggcatgaagggtaagcctggagcccgaggcctgccgggaccccgtgggcagctggggcccgagggagatgagggacccatggggccgccaggggcccctggcttggagggtcagcctggcaggaaggggtttcctgggaggcccggcctggatggcgtgaagggggaaccaggggatcctggtcggccggggcctgtgggagagcagggatttatgggattcattggtctggtcggggagccaggaatcgtgggagaaaagggtgatcgtggcatgatgggacccccaggcgtgcctggacccaaggggtcgatgggtcatcctggaatgccaggtggtatggggacccctggagagcctggaccccagggtcctccaggatctcgaggcccaccaggcatgaggggagcaaagggacgtcggggcccccgaggaccggacggaccagctggggagcaagggtccaggggcctgaagggccctccaggaccccagggcagaccgggccggcctggacagcagggtgtggctggtgagcgaggccacttgggctcgagaggctttcctggcatcccgggtccctcaggccccccaggcaccaagggcctcccaggagaaccgggccctcagggaccccaggggccaattgggcctccaggagagatgggacccaaggggccgcctggtgcagtgggagaaccgggccttcctggggaagccgggatgaagggtgaccttggacccctgggcactcctggggagcagggcctcattgggcaacggggagagccaggccttgagggtgacagtggccccatgggacctgatgggctgaagggggacaggggagacccagggcctgatggagaacatggcgagaaaggccaggaagggctgatgggtgaggacgggccccccggcccccctggcgtcactggtgtccggggtcctgaaggaaaatcagggaagcaaggcgagaagggccgcactggagccaagggtgccaagggctatcaaggacagctgggtgagatgggcgtccctggagaccctggaccccctggcactccaggccctaaagggtcccggggcagcctgggaccaacgggtgctccgggacgcatgggggcccaaggagaaccgggactggctggttatgatggacacaaaggcattgtgggaccccttggacctcctggaccaaaaggcgaaaagggggagcagggcgaggacggcaaggctgaggggccccctgggccacctggagatcggggccctgtgggtgatcgaggagaccgcggggaaccgggagaccctgggtaccctggacaggagggtgtgcaaggcctccgtggaaagccaggccagcagggccaacccgggcatccgggaccccgggggtggccgggacccaaaggatcgaaaggcgcagagggaccaaagggaaagcaaggcaaggcaggggccccaggccggaggggggtccagggcctgcaggggctgccagggccccggggcgtggtggggagacagggcctcgagggcatcgctggaccagatgggcttcctggcagggacgggcaagcaggacagcagggggagcagggagacgatggggaccctggccccatgggccctgctgggaagagaggaaatccaggtgtggccggcttacctggagcacagggacccccaggattcaagggtgagagtgggttacccggacagctgggtccccctggcaagcgaggaacagagggcagaacggggctccctggaaaccagggggagcctgggtccaaaggccagccgggcgactctggcgagatgggcttcccaggaatggcaggtctcttcggacccaagggcccgcctggagacattggcttcaaaggcatccagggccctcgggggccacctggcttgatgggaaaggaaggcatcgtcgggcccctcggaatcctgggaccttcgggactcccgggtccgaagggtgacaaaggcagccgtggggactggggattgcaaggtccgaggggtcctcccggccccagagggcggcccggccccccgggtcctccagggggtcctatccaattgcaacaagatgatcttggggcagctttccagacgtggatggacaccagtggagcactcaggccagagagttacagctatccagaccggctggtgctggaccagggaggagagatctttaaaaccttacactacctcagcaacctcatccagagcattaagacgcccctgggcaccaaagagaaccccgcccgggtctgcagggacctcatggactgtgagcagaagatggtggatggtacctactgggtggatccaaaccttggctgctcctctgacaccatcgaggtctcctgcaacttcactcatggtggacagacgtgtctcaagcccatcacggcctccaaggtcgagtttgccatcagccgggtccagatgaatttcctgcacctgctaagctccgaggtgacccagcacatcaccatccactgccttaacatgaccgtgtggcaggagggcactgggcagaccccagccaagcaggccgtacgcttccgggcctggaatggacagatttttgaagctgggggtcagttccggcccgaggtgtccatggatggctgcaaggtccaagatggccgctggcatcagacactcttcaccttccggacccaagacccccaacagctgcccatcatcagtgtggacaacctccctcctgcctcatcagggaagcagtaccgcctggaagttggacctgcgtgcttcctctga

SEQ ID NO: 44 - DNA, 5583 bp, Homo sapiens; identical to SEQ ID NO: 43

SEQ ID NO: 45 - protein, 1860 aa, Homo sapiens
MGAGSARGARGTAAAAAARGGGFLFSWILVSFACHLASTQGAPEDVDILQRLGLSWTKAGSPAPPGVIPFQSGFIFTQRARLQAPTGTVIPAALGTELALVLSLCSHRVNHAFLFAVRSQKRKLQLGLQFLPGKTVVHLGSRRSVAFDLDMHDGRWHHLALELRGRTVTLVTACGQRRVPVLLPFHRDPALDPGGSFLFGKMNPHAVQFEGALCQFSIYPVTQVAHNYCTHLRKQCGQADTYQSPLGPLFSQDSGRPFTFQSDLALLGLENLTTATPALGSLPAGRGPRGTVAPATPTKPQRTSPTNPHQHMAVGGPAQTPLLPAKLSASNALDPMLPASVGGSTRTPRPAAAQPSQKITATKIPKSLPTKPSAPSTSIVPIKSPHPTQKTAPSSFTKSALPTQKQVPPTSRPVPARVSRPAEKPIQRNPGMPRPPPPSTRPLPPTTSSSKKPIPTLARTEAKITSHASKPASARTSTHKPPPFTALSSSPAPTPGSTRSTRPPATMVPPTSGTSTPRTAPAVPTPGSAPTGSKKPIGSEASKKAGPKSSPRKPVPLRPGKAARDVPLSDLTTRPSPRQPQPSQQTTPALVLAPAQFLSSSPRPTSSGYSIFHLAGSTPFPLLMGPPGPKGDCGLPGPPGLPGLPGIPGARGPRGPPGPYGNPGLPGPPGAKGQKGDPGLSPGKAHDGAKGDMGLPGLSGNPGPPGRKGHKGYPGPAGHPGEQGQPGPEGSPGAKGYPGRQGLPGPVGDPGPKGSRGYIGLPGLFGLPGSDGERGLPGVPGKRGKMGMPGFPGVFGERGPPGLDGNPGELGLPGPPGVPGLIGDLGVLGPIGYPGPKGMKGLMGSVGEPGLKGDKGEQGVPGVSGDPGFQGDKGSQGLPGFPGARGKPGPLGKVGDKGSIGFPGPPGPEGFPGDIGPPGDNGPEGMKGKPGARGLPGPRGQLGPEGDEGPMGPPGAPGLEGQPGRKGFPGRPGLDGVKGEPGDPGRPGPVGEQGFMGFIGLVGEPGIVGEKGDRGMMGPPGVPGPKGSMGHPGMPGGMGTPGEPGPQGPPGSRGPPGMRGAKGRRGPRGPDGPAGEQGSRGLKGPPGPQGRPGRPGQQGVAGERGHLGSRGFPGIPGPSGPPGTKGLPGEPGPQGPQGPIGPPGEMGPKGPPGAVGEPGLPGEAGMKGDLGPLGTPGEQGLIGQRGEPGLEGDSGPMGPDGLKGDRGDPGPDGEHGEKGQEGLMGEDGPPGPPGVTGVRGPEGKSGKQGEKGRTGAKGAKGYQGQLGEMGVPGDPGPPGTPGPKGSRGSLGPTGAPGRMGAQGEPGLAGYDGHKGIVGPLGPPGPKGEKGEQGEDGKAEGPPGPPGDRGPVGDRGDRGEPGDPGYPGQEGVQGLRGKPGQQGQPGHPGPRGWPGPKGSKGAEGPKGKQGKAGAPGRRGVQGLQGLPGPRGVVGRQGLEGIAGPDGLPGRDGQAGQQGEQGDDGDPGPMGPAGKRGNPGVAGLPGAQGPPGFKGESGLPGQLGPPGKRGTEGRTGLPGNQGEPGSKGQPGDSGEMGFPGMAGLFGPKGPPGDIGFKGIQGPRGPPGLMGKEGIVGPLGILGPSGLPGPKGDKGSRGDWGLQGPRGPPGPRGRPGPPGPPGGPIQLQQDDLGAAFQTWMDTSGALRPESYSYPDRLVLDQGGEIFKTLHYLSNLIQSIKTPLGTKENPARVCRDLMDCEQKMVDGTYWVDPNLGCSSDTIEVSCNFTHGGQTCLKPITASKVEFAISRVQMNFLHLLSSEVTQHITIHCLNMTVWQEGTGQTPAKQAVRFRAWNGQIFEAGGQFRPEVSMDGCKVQDGRWHQTLFTFRTQDPQQLPIISVDNLPPASSGKQYRLEVGPACFL

SEQ ID NO: 46 - protein, 1860 aa, Homo sapiens; identical to SEQ ID NO: 45

SEQ ID NO: 47 - DNA, 3905 bp, Homo sapiens
ggggtctcggcgatcgctgctcctcctcctccttctcctcctcttttttctcctccgcctcctccccccgccgcctcgccaccgccgcggctagggctggaggcgccgctgtcattcctgtgccggaggaaccggcgctgccggtgcctgggggtcggggcgcgggcgaagccgggccgcggaggacacaacaggtagagccgggggtgcccggccgcgcgccccccgcgcatcatgcagctctttgtcacctctctcgcccccaggccaaaatcctgagcatgatggaagacaataagcagctcgcgctccgcatcgatggggcggtccagtcggccagccaggaggtgaccaacctgcgagccgaactcacggccaccaaccggagactggcggaactgagcggcggcggcggccccggcccgggcccgggagccgcggccagcgcctcggcggcgggggactcggcggcgacgaacatggagaacccccagcttggagcgcaagtgctcctgcgggaagaagtgtcgcggctccaggaggaagttcaccttctccggcagatgaaggagatgttggcgaaggacctggaggagtcgcagggcggcaagtcctctgaggtcctctcggccaccgagctcagggtccagctggcccagaaggagcaggagctagccagagccaaagaagccttgcaggccatgaaagctgatcggaagcgcttaaagggcgagaagacagacctggtgagccagatgcagcagctgtatgccacactggagagccgcgaggagcagctccgagacttcatccgcaactatgagcagcaccgcaaggagagcgaggatgcggtcaaagcgctggccaaggagaaggacctgctggagcgtgagaagtgggagctgcggcgccaagccaaggaggccacagaccacgccacggcactgcgctcccagctggacctcaaggacaaccggatgaaggagctggaggccgagctggccatggccaaacagtccttagctacgctgaccaaggacgtccccaagcggcattccctcgccatgccgggcgagacggtgctcaatggcaaccaggagtgggtggtgcaggcggacctcccgctgaccgcagccatccggcagagtcaacagactctctaccactcacacccccctcaccctgcggaccggcaagcggtcagggtgagcccctgccactcccggcagccctctgtcatctccgacgcatctgccgccgaaggcgaccggtcgtccacaccgagcgacatcaactcccctcgacaccggacacactccctctgcaacggcgacagtcccggcccagttcagaagaacctgcacaaccctattgtacagtcactagaggatcttgaagaccaaaaacggaaaaagaagaaagagaagatgggattcggctccatctcccgcgtcttcgccagagggaagcagcggaagtccctcgaccccggcctctttgatggtaccgcccctgattattacatagaggaggacgcggactggtgatacgcgctcccctgcgcctgctgcccgcaggcgtgtctgtgcgtgtgggcgtgtgtgcaagcgagcgtgggtgcgcgtgtggccgtgcgtggggtgcgtgtgcacgtgtgcgctggcacacatgggtgctgggtgtggccgagcgcctctaacaagtgaaaacacgagtgtgaacctctctcccctgcgtcgccacctctgtaattgatgtacataccgcaaaccgtgtgtgaacctgtcaactctctgtcgtctttggagcgatacagttgtgttgttaatctggtttattatttttcttcagtgtttggtttttctttttctttttgtttggttcgtcggtttgtttttgtttttgtttttttccccctttctcctcccctcctcctttttatgaaacttgaaaacttgaaggactgctgtgtatttgtaaataacaaaactattgtgcactctgtgcttgtaaatgtccctcgtccaaaccgctactcctggagcccgtctggcagaggatgtggtctgtttttgatgtcccccctcccgcccccctggtgtgaacgtgtgggaccagaccctgtcctgggggtgcgcccaagtcactttaaccacaaaacgccatcgtcgtcagggtaagctctgctctctacaaagactcgcgagccgggccaaggggccttgtcttggctgggtttgtcagaggtcaaaccggctcttttaaacggcctaccagtttttaaattgcattgccgtttctttctttatgaaaaaaaagaaaaaaagaaaattgtttcatttaatttatttgcacaaatgctgaaaacttattctatctaaattattacataaatattggaatgtctatttttccatggggtgggcgggaggtgggtgtctctgttgacttgtctgttctgttaccatgctgctacccaactgtgcaaagtagtttagggtggccagaacccagggaccattggatttcaaagcttgctttttctgttggttcttctctctccttctctctctgtctctcccattctcctgcccatgcatgaaaggatcctccaccttcttcccacccagagctccctccaggcctttctctatatatttatttatctgacatacagaacacgactttagtgagcagagtgctgacagtcatggtccccttctttgggtctgtcttttgagagaggttgagttcagggcaagacagcctgccacacatccaagggtacgaccagtgggaccctggcctgagtctgttctccgaggggcctccagcagcttctgttcctccctgcagctgtgtctttcttgtcctgggtttaggatgcaggtgggccaggcaggtgttgttaggggaggcacccacttcaaaaggagggccacagtggggacacagagtccagcacctgagccctccaccctccccattctggttggttccatcagccacacttagaatctcccaggatcccttggactccgtcccccaacttgtcacagcagcctgagcctacccaccccaggagacaagagctggcaggaacatctgcctatatggggggtggcgttggccccaaagaggcttcaccagcaaaggaactgtgtgtattttaatgccaggggacggaggatgtgtgagctgttcagcaaggtctgcccaaggcctaaaactcaatttccttattcttttgcttctgctcgtccttaacaactaacagctcaacccacacctctagacaacagtagtcgtgctttctgctaacggtgacattttcagctcttaaaaagaagcaaggagattttcaaatgctagagtatctctatcagaaggcataggacattgtgtccaaagtctcaagaacaaacaacactttccttctgacctggtccaaaagtcagcaaacagcaagcaggcagaggccctcataaggacttttctgtcctcctttgaccaaactgtttaaccgagcctaggggtgacggggagcgacccaagctggcatctttctctacggagacagattttagaaaatacttttcttgcccatgaatttcttttctggttgatttttatcattttccctttacttacaagaaaataagattgcaaccactcctgctaatgatttagtagttccttttcatttcagtttttgtaaattaggagataattctaagagttactaaaggatgatttatttaagagaactacgtcaaatagcgaatgagttatgggtaacattagacgaaaataacctttcccgtgggaaaggtttctcgaaggcatggatgcaaatataaaatattaaaaaaaatctaaataaagcttattttaaaatatgatcg

SEQ ID NO: 48 - DNA, 1475 bp, Homo sapiens
ggggtctcggcgatcgctgctcctcctcctccttctcctcctcttttttctcctccgcctcctccccccgccgcctcgccaccgccgcggctagggctggaggcgccgctgtcattcctgtgccggaggaaccggcgctgccggtgcctgggggtcggggcgcgggcgaagccgggccgcggaggacacaacaggccaaaatcctgagcatgatggaagacaataagcagctcgcgctccgcatcgatggggcggtccagtcggccagccaggaggtgaccaacctgcgagccgaactcacggccaccaaccggagactggcggaactgagcggcggcggcggccccggcccgggcccgggagccgcggccagcgcctcggcggcgggggactcggcggcgacgaacatggagaacccccagcttggagcgcaagtgctcctgcgggaagaagtgtcgcggctccaggaggaagttcaccttctccggcagatgaaggagatgttggcgaaggacctggaggagtcgcagggcggcaagtcctctgaggtcctctcggccaccgagctcagggtccagctggcccagaaggagcaggagctagccagagccaaagaagccttgcaggccatgaaagctgatcggaagcgcttaaagggcgagaagacagacctggtgagccagatgcagcagctgtatgccacactggagagccgcgaggagcagctccgagacttcatccgcaactatgagcagcaccgcaaggagagcgaggatgcggtcaaagcgctggccaaggagaaggacctgctggagcgtgagaagtgggagctgcggcgccaagccaaggaggccacagaccacgccacggcactgcgctcccagctggacctcaaggacaaccggatgaaggagctggaggccgagctggccatggccaaacagtccttagctacgctgaccaaggacgtccccaagcggcattccctcgccatgccgggcgagacggtgctcaatggcaaccaggagtgggtggtgcaggcggacctcccgctgaccgcagccatccggcagagtcaacagactctctaccactcacacccccctcaccctgcggaccggcaagcggtcagggtgagcccctgccactcccggcagccctctgtcatctccgacgcatctgccgccgaaggcgaccggtcgtccacaccgagcgacatcaactcccctcgacaccggacacactccctctgcaacggcgacagtcccggcccagttcagaagaacctgcacaaccctattgtacagtcactagaggatcttgaagaccaaaaacggaaaaagaagaaagagaagatgggattcggctccatctcccgcgtcttcgccagagggaagcagcggaagtccctcgaccccggcctctttgatggtaccgcccctgattattacatagaggaggacgcggactggtga

SEQ ID NO: 49 - protein, 421 aa, Homo sapiens
MMEDNKQLALRIDGAVQSASQEVTNLRAELTATNRRLAELSGGGGPGPGPGAAASASAAGDSAATNMENPQLGAQVLLREEVSRLQEEVHLLRQMKEMLAKDLEESQGGKSSEVLSATELRVQLAQKEQELARAKEALQAMKADRKRLKGEKTDLVSQMQQLYATLESREEQLRDFIRNYEQHRKESEDAVKALAKEKDLLEREKWELRRQAKEATDHATALRSQLDLKDNRMKELEAELAMAKQSLATLTKDVPKRHSLAMPGETVLNGNQEWVVQADLPLTAAIRQSQQTLYHSHPPHPADRQAVRVSPCHSRQPSVISDASAAEGDRSSTPSDINSPRHRTHSLCNGDSPGPVQKNLHNPIVQSLEDLEDQKRKKKKEKMGFGSISRVFARGKQRKSLDPGLFDGTAPDYYIEEDADW

SEQ ID NO: 50 - protein, 421 aa, Homo sapiens; identical to SEQ ID NO: 49
  Kazrin isoform-4

SEQ ID NO: 51 - DNA, 1276 bp, Homo sapiens
tcacacactcacttacacctcccccagctcacctcctccccaccccagcatggccgcgtccaccatgtccatccgctccagcgcttactccgactcctggcaggtggacgactgcccagagagctgctgtgagcccccctgctgcgccaccagctgctgcgccccggccccctgcctgaccctggtctgcaccccagtgagccgtgtatccagcccctgctgccaggtgacctgtgagcccagcccctgccaatcaggctgcaccagctcctgcacgccctcgtgctgccagcagtctagctgccagccggcttactgcacctcctccccctgccagcaggcctgctgcgtgcccgtctgctgcaagcctgtgtgctgcgtgcccgtctgctgtggggcttcttcgtgctgccaacagtctagctaccagccagcttgctgtgcctcttcctcctgccagccggcctgctgtgtgcccgtctgctgcaaacctgtgtgctgtgcgcccacctgctctgaggattcctattcatgctgccaacagtctagctgccagccagcttgctgcacttcctccccctgccagcagtcctactgtgtgcctgtctgctgtaagcctgtctgctgcaaacccatctgctgtgtgcctgtctgctctggggcttcctctttgtgctgccagcagtctggctgccagccggcttgctgcaccacctcctgctgcagaccctcctcctctgtgtccctcctctgccgccctgtgtgcaggcccgcctgctgcgtgcccgtctcctcctgctgtgcccccacctcctcccgccagcccagctattgccgccaggcctcctgtgtgtcccttctctgccgccctgtgtgctcccgcccggcctgctacagcttctcctcaggccagaagtccagctgctgacggtcatgtcccccagggccagccgggctcaggccccacctccctgccagtccttggacctcccagcccacccagcctcagcacagctcaacacagaaggagcagccccagccacagccgcccagccccggggtctcagatgctcactggctcctccctgacctcccccccgggcaggcgagccctggcttctcctcacggtgcttcctggctgcagaccacaaccctccgctggtcgctggttggggacgggccctcctgacccgggtctcacccccagcagcgtcaccctctgcccctgagcaccaataaagcgtctgcggccccaaaaaaaaaaaaaaaaaaaaa

SEQ ID NO: 52 - DNA, 1012 bp, Homo sapiens
cagctcacctcctccccaccccagcatggccgcgtccaccatgtccatccgctccagcgcttactccgactcctggcaggtggacgactgcccagagagctgctgtgagcccccctgctgcgccaccagctgctgcgccccggccccctgcctgaccctggtctgcaccccagtgagccgtgtatccagcccctgctgccaggtgacctgtgagcccagcccctgccaatcaggctgcaccagctcctgcacgccctcgtgctgccagcagtctagctgccagccggcttactgcacctcctccccctgccagcaggcctgctgcgtgcccgtctgctgcaagcctgtgtgctgtgtgcccgtctgctgtggggcttcttcgtgctgccaacagtctagctaccagccagcttgctgtgcctcttcctcctgccagccggcctgctgtgtgcccgtctgctgcaaacctgtgtgctgtgcgcccacctgctctgaggattcctattcatgctgccaacagtctagctgccagccagcttgctgcacttcctccccctgccagcagtcctgctgtgtgcctgtctgctgtaagcctgtctgctgcaaacccatctgctgtgtgcctgtctgctctggggcttcctctctgtgctgccagcagtctggctgccagccggcttgctgcaccacctcctgctgcagaccctcctcctctgtgtccctcctctgccgccctgtgtgcaggcccgcctgctgcgtgcccgtctcctcctgctgtgcccccacctcctcctgccagcccagctattgccgccaggcctcctgtgtgtcccttctctgccgccctgtgtgctcccgccctgcctgctacagcttctcctcaggccagaagtccagctgctgacggccatgtcccccagggccagccgggctcaggccccacctccctgccagtccttggacctcccagcccacccagcctcagcacacctcaacgcagaaggagcagccc

SEQ ID NO: 53 - protein, 292 aa, Homo sapiens
MAASTMSIRSSAYSDSWQVDDCPESCCEPPCCATSCCAPAPCLTLVCTPVSRVSSPCCQVTCEPSPCQSGCTSSCTPSCCQQSSCQPAYCTSSPCQQACCVPVCCKPVCCVPVCCGASSCCQQSSYQPACCASSSCQPACCVPVCCKPVCCAPTCSEDSYSCCQQSSCQPACCTSSPCQQSYCVPVCCKPVCCKPICCVPVCSGASSLCCQQSGCQPACCTTSCCRPSSSVSLLCRPVCRPACCVPVSSCCAPTSSRQPSYCRQASCVSLLCRPVCSRPACYSFSSGQKSSC

SEQ ID NO: 54 - protein, 292 aa, Homo sapiens [sequence omitted]

SEQ ID NO: 55 - DNA, 13481 bp, Homo sapiens
gctgccgggacgggtccaagatggacggccgctcaggttctgcttttacctgcggcccagagccccattcattgccccggtgctgagcggcgccgcgagtcggcccgaggcctccggggactgccgtgccgggcgggagaccgccatggcgaccctggaaaagctgatgaaggccttcgagtccctcaagtccttccagcagcagcagcagcagcagcagcagcagcagcagcagcagcagcagcagcagcagcagcagcaacagccgccaccgccgccgccgccgccgccgcctcctcagcttcctcagccgccgccgcaggcacagccgctgctgcctcagccgcagccgcccccgccgccgcccccgccgccacccggcccggctgtggctgaggagccgctgcaccgaccaaagaaagaactttcagctaccaagaaagaccgtgtgaatcattgtctgacaatatgtgaaaacatagtggcacagtctgtcagaaattctccagaatttcagaaacttctgggcatcgctatggaactttttctgctgtgcagtgatgacgcagagtcagatgtcaggatggtggctgacgaatgcctcaacaaagttatcaaagctttgatggattctaatcttccaaggttacagctcgagctctataaggaaattaaaaagaatggtgcccctcggagtttgcgtgctgccctgtggaggtttgctgagctggctcacctggttcggcctcagaaatgcaggccttacctggtgaaccttctgccgtgcctgactcgaacaagcaagagacccgaagaatcagtccaggagaccttggctgcagctgttcccaaaattatggcttcttttggcaattttgcaaatgacaatgaaattaaggttttgttaaaggccttcatagcgaacctgaagtcaagctcccccaccattcggcggacagcggctggatcagcagtgagcatctgccagcactcaagaaggacacaatatttctatagttggctactaaatgtgctcttaggcttactcgttcctgtcgaggatgaacactccactctgctgattcttggcgtgctgctcaccctgaggtatttggtgcccttgctgcagcagcaggtcaaggacacaagcctgaaaggcagcttcggagtgacaaggaaagaaatggaagtctctccttctgcagagcagcttgtccaggtttatgaactgacgttacatcatacacagcaccaagaccacaatgttgtgaccggagccctggagctgttgcagcagctcttcagaacgcctccacccgagcttctgcaaaccctgaccgcagtcgggggcattgggcagctcaccgctgctaaggaggagtctggtggccgaagccgtagtgggagtattgtggaacttatagctggagggggttcctcatgcagccctgtcctttcaagaaaacaaaaaggcaaagtgctcttaggagaagaagaagccttggaggatgactctgaatcgagatcggatgtcagcagctctgccttaacagcctcagtgaaggatgagatcagtggagagctggctgcttcttcaggggtttccactccagggtcagcaggtcatgacatcatcacagaacagccacggtcacagcacacactgcaggcggactcagtggatctggccagctgtgacttgacaagctctgccactgatggggatgaggaggatatcttgagccacagctccagccaggtcagcgccgtcccatctgaccctgccatggacctgaatgatgggacccaggcctcgtcgcccatcagcgacagctcccagaccaccaccgaagggcctgattcagctgttaccccttcagacagttctgaaattgtgttagacggtaccgacaaccagtatttgggcctgcagattggacagccccaggatgaagatgaggaagccacaggtattcttcctgatgaagcctcggaggccttcaggaactcttccatggcccttcaacaggcacatttattgaaaaacatgagtcactgcaggcagccttctgacagcagtgttgataaatttgtgttgagagatgaagctactgaaccgggtgatcaagaaaacaagccttgccgcatcaaaggtgacattggacagtccactgatgatgactctgcacctcttgtccattgtgtccgccttttatctgcttcgtttttgctaacagggggaaaaaatgtgctggttccggacagggatgtgagggtcagcgtgaaggccctggccctcagctgtgtgggagcagctgtggccctccacccggaatctttcttcagcaaactctataaagttcctcttgacaccacggaataccctgaggaacagtatgtctcagacatcttgaactacatcgatcatggagacccacaggttcgaggagccactgccattctctgtgggaccctcatctgctccatcctcagcaggtcccgcttccacgtgggagattggatgggcaccattagaaccctcacaggaaatacattttctttggcggattgcattcctttgctgcggaaaacactgaaggatgagtcttctgttacttgcaagttagcttgtacagctgtgaggaactgtgtcatgagtctctgcagcagcagctacagtgagttaggactgcagctgatcatcgatgtgctgactctgaggaacagttcctattggctggtgaggacagagcttctggaaacccttgcagagattgacttcaggctggtgagctttttggaggcaaaagcagaaaacttacacagaggggctcatcattatacagggcttttaaaactgcaagaacgagtgctcaataatgttgtcatccatttgcttggagatgaagaccccagggtgcgacatgttgccgcagcatcactaattaggcttgtcccaaagctgttttataaatgtgaccaaggacaagctgatccagtagtggccgtggcaagagatcaaagcagtgtttacctgaaacttctcatgcatgagacgcagcctccatctcatttctccgtcagcacaataaccagaatatatagaggctataacctactaccaagcataacagacgtcactatggaaaataacctttcaagagttattgcagcagtttctcatgaactaatcacatcaaccaccagagcactcacatttggatgctgtgaagctttgtgtcttctttccactgccttcccagtttgcatttggagtttaggttggcactgtggagtgcctccactgagtgcctcagatgagtctaggaagagctgtaccgttgggatggccacaatgattctgaccctgctctcgtcagcttggttcccattggatctctcagcccatcaagatgctttgattttggccggaaacttgcttgcagccagtgctcccaaatctctgagaagttcatgggcctctgaagaagaagccaacccagcagccaccaagcaagaggaggtctggccagccctgggggaccgggccctggtgcccatggtggagcagctcttctctcacctgctgaaggtgattaacatttgtgcccacgtcctggatgacgtggctcctggacccgcaataaaggcagccttgccttctctaacaaaccccccttctctaagtcccatccgacgaaaggggaaggagaaagaaccaggagaacaagcatctgtaccgttgagtcccaagaaaggcagtgaggccagtgcagcttctagacaatctgatacctcaggtcctgttacaacaagtaaatcctcatcactggggagtttctatcatcttccttcatacctcaaactgcatgatgtcctgaaagctacacacgctaactacaaggtcacgctggatcttcagaacagcacggaaaagtttggagggtttctccgctcagccttggatgttctttctcagatactagagctggccacactgcaggacattgggaagtgtgttgaagagatcctaggatacctgaaatcctgctttagtcgagaaccaatgatggcaactgtttgtgttcaacaattgttgaagactctctttggcacaaacttggcctcccagtttgatggcttatcttccaaccccagcaagtcacaaggccgagcacagcgccttggctcctccagtgtgaggccaggcttgtaccactactgcttcatggccccgtacacccacttcacccaggccctcgctgacgccagcctgaggaacatggtgcaggcggagcaggagaacgacacctcgggatggtttgatgtcctccagaaagtgtctacccagttgaagacaaacctcacgagtgtcacaaagaaccgtgcagataagaatgctattcataatcacattcgtttgtttgaacctcttgttataaaagctttaaaacagtacacgactacaacatgtgtgcagttacagaagcaggttttagatttgctggcgcagctggttcagttacgggttaattactgtcttctggattcagatcaggtgtttattggctttgtattgaaacagtttgaatacattgaagtgggccagttcagggaatcagaggcaatcattccaaacatctttttcttcttggtattactatcttatgaacgctatcattcaaaacagatcattggaattcctaaaatcattcagctctgtgatggcatcatggccagtggaaggaaggctgtgacacatgccataccggctctgcagcccatagtccacgacctctttgtattaagaggaacaaataaagctgatgcaggaaaagagcttgaaacccaaaaagaggtggtggtgtcaatgttactgagactcatccagtaccatcaggtgttggagatgttcattcttgtcctgcagcagtgccacaaggagaatgaagacaagtggaagcgactgtctcgacagatagctgacatcatcctcccaatgttagccaaacagcagatgcacattgactctcatgaagcccttggagtgttaaatacattatttgagattttggccccttcctccctccgtccggtagacatgcttttacggagtatgttcgtcactccaaacacaatggcgtccgtgagcactgttcaactgtggatatcgggaattctggccattttgagggttctgatttcccagtcaactgaagatattgttctttctcgtattcaggagctctccttctctccgtatttaatctcctgtacagtaattaataggttaagagatggggacagtacttcaacgctagaagaacacagtgaagggaaacaaataaagaatttgccagaagaaacattttcaaggtttctattacaactggttggtattcttttagaagacattgttacaaaacagctgaaggtggaaatgagtgagcagcaacatactttctattgccaggaactaggcacactgctaatgtgtctgatccacatcttcaagtctggaatgttccggagaatcacagcagctgccactaggctgttccgcagtgatggctgtggcggcagtttctacaccctggacagcttgaacttgcgggctcgttccatgatcaccacccacccggccctggtgctgctctggtgtcagatactgctgcttgtcaaccacaccgactaccgctggtgggcagaagtgcagcagaccccgaaaagacacagtctgtccagcacaaagttacttagtccccagatgtctggagaagaggaggattctgacttggcagccaaacttggaatgtgcaatagagaaatagtacgaagaggggctctcattctcttctgtgattatgtctgtcagaacctccatgactccgagcacttaacgtggctcattgtaaatcacattcaagatctgatcagcctttcccacgagcctccagtacaggacttcatcagtgccgttcatcggaactctgctgccagcggcctgttcatccaggcaattcagtctcgttgtgaaaacctttcaactccaaccatgctgaagaaaactcttcagtgcttggaggggatccatctcagccagtcgggagctgtgctcacgctgtatgtggacaggcttctgtgcacccctttccgtgtgctggctcgcatggtcgacatccttgcttgtcgccgggtagaaatgcttctggctgcaaatttacagagcagcatggcccagttgccaatggaagaactcaacagaatccaggaataccttcagagcagcgggctcgctcagagacaccaaaggctctattccctgctggacaggtttcgtctctccaccatgcaagactcacttagtccctctcctccagtctcttcccacccgctggacggggatgggcacgtgtcactggaaacagtgagtccggacaaagactggtacgttcatcttgtcaaatcccagtgttggaccaggtcagattctgcactgctggaaggtgcagagctggtgaatcggattcctgctgaagatatgaatgccttcatgatgaactcggagttcaacctaagcctgctagctccatgcttaagcctagggatgagtgaaatttctggtggccagaagagtgccctttttgaagcagcccgtgaggtgactctggcccgtgtgagcggcaccgtgcagcagctccctgctgtccatcatgtcttccagcccgagctgcctgcagagccggcggcctactggagcaagttgaatgatctgtttggggatgctgcactgtatcagtccctgcccactctggcccgggccctggcacagtacctggtggtggtctccaaactgcccagtcatttgcaccttcctcctgagaaagagaaggacattgtgaaattcgtggtggcaacccttgaggccctgtcctggcatttgatccatgagcagatcccgctgagtctggatctccaggcagggctggactgctgctgcctggccctgcagctgcctggcctctggagcgtggtctcctccacagagtttgtgacccacgcctgctccctcatctactgtgtgcacttcatcctggaggccgttgcagtgcagcctggagagcagcttcttagtccagaaagaaggacaaataccccaaaagccatcagcgaggaggaggaggaagtagatccaaacacacagaatcctaagtatatcactgcagcctgtgagatggtggcagaaatggtggagtctctgcagtcggtgttggccttgggtcataaaaggaatagcggcgtgccggcgtttctcacgccattgctaaggaacatcatcatcagcctggcccgcctgccccttgtcaacagctacacacgtgtgcccccactggtgtggaagcttggatggtcacccaaaccgggaggggattttggcacagcattccctgagatccccgtggagttcctccaggaaaaggaagtctttaaggagttcatctaccgcatcaacacactaggctggaccagtcgtactcagtttgaagaaacttgggccaccctccttggtgtcctggtgacgcagcccctcgtgatggagcaggaggagagcccaccagaagaagacacagagaggacccagatcaacgtcctggccgtgcaggccatcacctcactggtgctcagtgcaatgactgtgcctgtggccggcaacccagctgtaagctgcttggagcagcagccccggaacaagcctctgaaagctctcgacaccaggtttgggaggaagctgagcattatcagagggattgtggagcaagagattcaagcaatggtttcaaagagagagaatattgccacccatcatttatatcaggcatgggatcctgtcccttctctgtctccggctactacaggtgccctcatcagccacgagaagctgctgctacagatcaaccccgagcgggagctggggagcatgagctacaaactcggccaggtgtccatacactccgtgtggctggggaacagcatcacacccctgagggaggaggaatgggacgaggaagaggaggaggaggccgacgcccctgcaccttcgtcaccacccacgtctccagtcaactccaggaaacaccgggctggagttgacatccactcctgttcgcagtttttgcttgagttgtacagccgctggatcctgccgtccagctcagccaggaggaccccggccatcctgatcagtgaggtggtcagatcccttctagtggtctcagacttgttcaccgagcgcaaccagtttgagctgatgtatgtgacgctgacagaactgcgaagggtgcacccttcagaagacgagatcctcgctcagtacctggtgcctgccacctgcaaggcagctgccgtccttgggatggacaaggccgtggcggagcctgtcagccgcctgctggagagcacgctcaggagcagccacctgcccagcagggttggagccctgcacggcgtcctctatgtgctggagtgcgacctgctggacgacactgccaagcagctcatcccggtcatcagcgactatctcctctccaacctgaaagggatcgcccactgcgtgaacattcacagccagcagcacgtactggtcatgtgtgccactgcgttttacctcattgagaactatcctctggacgtagggccggaattttcagcatcaataatacagatgtgtggggtgatgctgtctggaagtgaggagtccaccccctccatcatttaccactgtgccctcagaggcctggagcgcctcctgctctctgagcagctctcccgcctggatgcagaatcgctggtcaagctgagtgtggacagagtgaacgtgcacagcccgcaccgggccatggcggctctgggcctgatgctcacctgcatgtacacaggaaaggagaaagtcagtccgggtagaacttcagaccctaatcctgcagcccccgacagcgagtcagtgattgttgctatggagcgggtatctgttctttttgataggatcaggaaaggctttccttgtgaagccagagtggtggccaggatcctgccccagtttctagacgacttcttcccaccccaggacatcatgaacaaagtcatcggagagtttctgtccaaccagcagccatacccccagttcatggccaccgtggtgtataaggtgtttcagactctgcacagcaccgggcagtcgtccatggtccgggactgggtcatgctgtccctctccaacttcacgcagagggccccggtcgccatggccacgtggagcctctcctgcttctttgtcagcgcgtccaccagcccgtgggtcgcggcgatcctcccacatgtcatcagcaggatgggcaagctggagcaggtggacgtgaaccttttctgcctggtcgccacagacttctacagacaccagatagaggaggagctcgaccgcagggccttccagtctgtgcttgaggtggttgcagccccaggaagcccatatcaccggctgctgacttgtttacgaaatgtccacaaggtcaccacctgctgagcgccatggtgggagagactgtgaggcggcagctggggccggagcctttggaagtctgcgcccttgtgccctgcctccaccgagccagcttggtccctatgggcttccgcacatgccgcgggcggccaggcaacgtgcgtgtctctgccatgtggcagaagtgctctttgtggcagtggccaggcagggagtgtctgcagtcctggtggggctgagcctgaggccttccagaaagcaggagcagctgtgctgcaccccatgtgggtgaccaggtcctttctcctgatagtcacctgctggttgttgccaggttgcagctgctcttgcatctgggccagaagtcctccctcctgcaggctggctgttggcccctctgctgtcctgcagtagaaggtgccgtgagcaggctttgggaacactggcctgggtctccctggtggggtgtgcatgccacgccccgtgtctggatgcacagatgccatggcctgtgctgggccagtggctgggggtgctagacacccggcaccattctcccttctctcttttcttctcaggatttaaaatttaattatatcagtaaagagattaattttaacgtaactctttctatgcccgtgtaaagtatgtgaatcgcaaggcctgtgctgcatgcgacagcgtccggggtggtggacagggcccccggccacgctccctctcctgtagccactggcatagccctcctgagcacccgctgacatttccgttgtacatgttcctgtttatgcattcacaaggtgactgggatgtagagaggcgttagtgggcaggtggccacagcaggactgaggacaggcccccattatcctaggggtgcgctcacctgcagcccctcctcctcgggcacagacgactgtcgttctccacccaccagtcagggacagcagcctccctgtcactcagctgagaaggccagccctccctggctgtgagcagcctccactgtgtccagagacatgggcctcccactcctgttccttgctagccctggggtggcgtctgcctaggagctggctggcaggtgttgggacctgctgctccatggatgcatgccctaagagtgtcactgagctgtgttttgtctgagcctctctcggtcaacagcaaagcttggtgtcttggcactgttagtgacagagcccagcatcccttctgcccccgttccagctgacatcttgcacggtgaccccttttagtcaggagagtgcagatctgtgctcatcggagactgccccacggccctgtcagagccgccactcctatccccaggccaggtccctggaccagcctcctgtttgcaggcccagaggagccaagtcattaaaatggaagtggattctggatggccgggctgctgctgatgtaggagctggatttgggagctctgcttgccgactggctgtgagacgaggcaggggctctgcttcctcagccctagaggcgagccaggcaaggttggcgactgtcatgtggcttggtttggtcatgcccgtcgatgttttgggtattgaatgtggtaagtggaggaaatgttggaactctgtgcaggtgctgccttgagacccccaagcttccacctgtccctctcctatgtggcagctggggagcagctgagatgtggacttgtatgctgcccacatacgtgagggggagctgaaagggagcccctcctctgagcagcctctgccaggcctgtatgaggcttttcccaccagctcccaacagaggcctcccccagccaggaccacctcgtcctcgtggcggggcagcaggagcggtagaaaggggtccgatgtttgaggaggcccttaagggaagctactgaattataacacgtaagaaaatcaccattccgtattggttgggggctcctgtttctcatcctagctttttcctggaaagcccgctagaaggtttgggaacgaggggaaagttctcagaactgttggctgctccccacccgcctcccgcctcccccgcaggttatgtcagcagctctgagacagcagtatcacaggccagatgttgttcctggctagatgtttacatttgtaagaaataacactgtgaatgtaaaacagagccattcccttggaatgcatatcgctgggctcaacatagagtttgtcttcctcttgtttacgacgtgatctaaaccagtccttagcaaggggctcagaacaccccgctctggcagtaggtgtcccccacccccaaagacctgcctgtgtgctccggagatgaatatgagctcattagtaaaaatgacttcacccacgcatatacataaagtatccatgcatgtgcatatagacacatctataattttacacacacacctctcaagacggagatgcatggcctctaagagtgcccgtgtcggttcttcctggaagttgactttccttagacccgccaggtcaagttagccgcgtgacggacatccaggcgtgggacgtggtcagggcagggctcattcattgcccactaggatcccactggcgaagatggtctccatatcagctctctgcagaagggaggaagactttatcatgttcctaaaaatctgtggcaagcacccatcgtattatccaaattttgttgcaaatgtgattaatttggttgtcaagttttgggggtgggctgtggggagattgcttttgttttcctgctggtaatatcgggaaagattttaatgaaaccagggtagaattgtttggcaatgcactgaagcgtgtttctttcccaaaatgtgcctcccttccgctgcgggcccagctgagtctatgtaggtgatgtttccagctgccaagtgctctttgttactgtccaccctcatttctgccagcgcatgtgtcctttcaaggggaaaatgtgaagctgaaccccctccagacacccagaatgtagcatctgagaaggccctgtgccctaaaggacacccctcgcccccatcttcatggagggggtcatttcagagccctcggagccaatgaacagctcctcctcttggagctgagatgagccccacgtggagctcgggacggatagtagacagcaataactcggtgtgtggccgcctggcaggtggaacttcctcccgttgcggggtggagtgaggttagttctgtgtgtctggtgggtggagtcaggcttctcttgctacctgtgagcatccttcccagcagacatcctcatcgggctttgtccctcccccgcttcctccctctgcggggaggacccgggaccacagctgctggccagggtagacttggagctgtcctccagaggggtcacgtgtaggagtgagaagaaggaagatcttgagagctgctgagggaccttggagagctcaggatggctcagacgaggacactcgcttgccgggcctgggcctcctgggaaggagggagctgctcagaatgccgcatgacaactgaaggcaacctggaaggttcaggggccgctcttcccccatgtgcctgtcacgctctggtgcagtcaaaggaacgccttcccctcagttgtttctaagagcagagtctcccgctgcaatctgggtggtaactgccagccttggaggatcgtggccaacgtggacctgcctacggagggtgggctctgacccaagtggggcctccttgtccaggtctcactgctttgcaccgtggtcagagggactgtcagctgagcttgagctcccctggagccagcagggctgtgatgggcgagtcccggagccccacccagacctgaatgcttctgagagcaaagggaaggactgacgagagatgtatatttaattttttaactgctgcaaacattgtacatccaaattaaaggaaaaaaatggaaaccatca

SEQ ID NO: 56 - protein, 3144 aa, Homo sapiens
MATLEKLMKAFESLKSFQQQQQQQQQQQQQQQQQQQQQQQPPPPPPPPPPPQLPQPPPQAQPLLPQPQPPPPPPPPPPGPAVAEEPLHRPKKELSATKKDRVNHCLTICENIVAQSVRNSPEFQKLLGIAMELFLLCSDDAESDVRMVADECLNKVIKALMDSNLPRLQLELYKEIKKNGAPRSLRAALWRFAELAHLVRPQKCRPYLVNLLPCLTRTSKRPEESVQETLAAAVPKIMASFGNFANDNEIKVLLKAFIANLKSSSPTIRRTAAGSAVSICQHSRRTQYFYSWLLNVLLGLLVPVEDEHSTLLILGVLLTLRYLVPLLQQQVKDTSLKGSFGVTRKEMEVSPSAEQLVQVYELTLHHTQHQDHNVVTGALELLQQLFRTPPPELLQTLTAVGGIGQLTAAKEESGGRSRSGSIVELIAGGGSSCSPVLSRKQKGKVLLGEEEALEDDSESRSDVSSSALTASVKDEISGELAASSGVSTPGSAGHDIITEQPRSQHTLQADSVDLASCDLTSSATDGDEEDILSHSSSQVSAVPSDPAMDLNDGTQASSPISDSSQTTTEGPDSAVTPSDSSEIVLDGTDNQYLGLQIGQPQDEDEEATGILPDEASEAFRNSSMALQQAHLLKNMSHCRQPSDSSVDKFVLRDEATEPGDQENKPCRIKGDIGQSTDDDSAPLVHCVRLLSASFLLTGGKNVLVPDRDVRVSVKALALSCVGAAVALHPESFFSKLYKVPLDTTEYPEEQYVSDILNYIDHGDPQVRGATAILCGTLICSILSRSRFHVGDWMGTIRTLTGNTFSLADCIPLLRKTLKDESSVTCKLACTAVRNCVMSLCSSSYSELGLQLIIDVLTLRNSSYWLVRTELLETLAEIDFRLVSFLEAKAENLHRGAHHYTGLLKLQERVLNNVVIHLLGDEDPRVRHVAAASLIRLVPKLFYKCDQGQADPVVAVARDQSSVYLKLLMHETQPPSHFSVSTITRIYRGYNLLPSITDVTMENNLSRVIAAVSHELITSTTRALTFGCCEALCLLSTAFPVCIWSLGWHCGVPPLSASDESRKSCTVGMATMILTLLSSAWFPLDLSAHQDALILAGNLLAASAPKSLRSSWASEEEANPAATKQEEVWPALGDRALVPMVEQLFSHLLKVINICAHVLDDVAPGPAIKAALPSLTNPPSLSPIRRKGKEKEPGEQASVPLSPKKGSEASAASRQSDTSGPVTTSKSSSLGSFYHLPSYLKLHDVLKATHANYKVTLDLQNSTEKFGGFLRSALDVLSQILELATLQDIGKCVEEILGYLKSCFSREPMMATVCVQQLLKTLFGTNLASQFDGLSSNPSKSQGRAQRLGSSSVRPGLYHYCFMAPYTHFTQALADASLRNMVQAEQENDTSGWFDVLQKVSTQLKTNLTSVTKNRADKNAIHNHIRLFEPLVIKALKQYTTTTCVQLQKQVLDLLAQLVQLRVNYCLLDSDQVFIGFVLKQFEYIEVGQFRESEAIIPNIFFFLVLLSYERYHSKQIIGIPKIIQLCDGIMASGRKAVTHAIPALQPIVHDLFVLRGTNKADAGKELETQKEVVVSMLLRLIQYHQVLEMFILVLQQCHKENEDKWKRLSRQIADIILPMLAKQQMHIDSHEALGVLNTLFEILAPSSLRPVDMLLRSMFVTPNTMASVSTVQLWISGILAILRVLISQSTEDIVLSRIQELSFSPYLISCTVINRLRDGDSTSTLEEHSEGKQIKNLPEETFSRFLLQLVGILLEDIVTKQLKVEMSEQQHTFYCQELGTLLMCLIHIFKSGMFRRITAAATRLFRSDGCGGSFYTLDSLNLRARSMITTHPALVLLWCQILLLVNHTDYRWWAEVQQTPKRHSLSSTKLLSPQMSGEEEDSDLAAKLGMCNREIVRRGALILFCDYVCQNLHDSEHLTWLIVNHIQDLISLSHEPPVQDFISAVHRNSAASGLFIQAIQSRCENLSTPTMLKKTLQCLEGIHLSQSGAVLTLYVDRLLCTPFRVLARMVDILACRRVEMLLAANLQSSMAQLPMEELNRIQEYLQSSGLAQRHQRLYSLLDRFRLSTMQDSLSPSPPVSSHPLDGDGHVSLETVSPDKDWYVHLVKSQCWTRSDSALLEGAELVNRIPAEDMNAFMMNSEFNLSLLAPCLSLGMSEISGGQKSALFEAAREVTLARVSGTVQQLPAVHHVFQPELPAEPAAYWSKLNDLFGDAALYQSLPTLARALAQYLVVVSKLPSHLHLPPEKEKDIVKFVVATLEALSWHLIHEQIPLSLDLQAGLDCCCLALQLPGLWSVVSSTEFVTHACSLIYCVHFILEAVAVQPGEQLLSPERRTNTPKAISEEEEEVDPNTQNPKYITAACEMVAEMVESLQSVLALGHKRNSGVPAFLTPLLRNIIISLARLPLVNSYTRVPPLVWKLGWSPKPGGDFGTAFPEIPVEFLQEKEVFKEFIYRINTLGWTSRTQFEETWATLLGVLVTQPLVMEQEESPPEEDTERTQINVLAVQAITSLVLSAMTVPVAGNPAVSCLEQQPRNKPLKALDTRFGRKLSIIRGIVEQEIQAMVSKRENIATHHLYQAWDPVPSLSPATTGALISHEKLLLQINPERELGSMSYKLGQVSIHSVWLGNSITPLREEEWDEEEEEEADAPAPSSPPTSPVNSRKHRAGVDIHSCSQFLLELYSRWILPSSSARRTPAILISEVVRSLLVVSDLFTERNQFELMYVTLTELRRVHPSEDEILAQYLVPATCKAAAVLGMDKAVAEPVSRLLESTLRSSHLPSRVGALHGVLYVLECDLLDDTAKQLIPVISDYLLSNLKGIAHCVNIHSQQHVLVMCATAFYLIENYPLDVGPEFSASIIQMCGVMLSGSEESTPSIIYHCALRGLERLLLSEQLSRLDAESLVKLSVDRVNVHSPHRAMAALGLMLTCMYTGKEKVSPGRTSDPNPAAPDSESVIVAMERVSVLFDRIRKGFPCEARVVARILPQFLDDFFPPQDIMNKVIGEFLSNQQPYPQFMATVVYKVFQTLHSTGQSSMVRDWVMLSLSNFTQRAPVAMATWSLSCFFVSASTSPWVAAILPHVISRMGKLEQVDVNLFCLVATDFYRHQIEEELDRRAFQSVLEVVAAPGSPYHRLLTCLRNVHKVTTC

SEQ ID NO: 57 - DNA, 7333 bp, Homo sapiens
acttccttcgtctgggtggttgccccagcgacacgttgggccgaagagcggtgttgggtacccgagagacccggcggtggggaagtcacttcctcccgaagacgctgtttcctagcaaccgccctccgcctctgttattagcccctcctcctcgctcggtccaggaccggctctgcgggcgccgccaggcccagaccaagctactatcagaagttgaattctaataattagctattttataaaggtaacgagaaaaaatacactatgtctgatgaagtttttagcaccactttggcatatacaaagagtccaaaagttaccaaaagaactactttccaggatgagctaataagagcaattacagctcgctcagccagacaaaggagttctgaatactcagatgactttgacagtgatgagattgtttctttaggtgatttttctgacacttcagcagatgaaaattcagttaataaaaaaatgaatgactttcatatatcagatgatgaagaaaagaatccttcaaaactattgtttttgaaaaccaataaatcaaacggtaacataaccaaagatgagccagtgtgtgccatcaaaaatgaagaggaaatggcacctgatgggtgtgaagacattgttgtaaaatctttctctgaatctcaaaataaggatgaggaatttgaaaaagacaaaataaaaatgaaacctaaacccagaattctttcaattaaaagcacatcttcagcagaaaacaacagccttgacacagatgatcactttaaaccatcacctcggccaaggagtatgttgaaaaagaaaagtcacatggaggagaaggatggactagaagataaagaaactgccctcagtgaagaattggagttacattctgcaccttcttcccttccaacgccgaatggcatacaattagaagctgagaaaaaagcattctctgaaaaccttgatcctgaggattcatgcttaacaagtctagcatcatcatcacttaaacaaattcttggagattctttttcaccaggatctgagggaaacgcatctggaaaagatccaaatgaagaaatcactgaaaaccataattccttgaaatcagatgaaaataaagagaattcattttcagcagaccatgtgactactgcagttgagaaatccaaggaaagtcaagtgactgctgatgaccttgaagaagaaaaggcaaaagcggaactgattatggatgatgacagaacagttgatccactactatctaaatctcagagtatcttaatatctaccagtgcaacagcatcttcaaagaaaacaattgaagatagaaatataaagaataaaaagtcaacaaataatagagcatccagtgcatctgccagattaatgacctctgagtttttgaagaaatctagttctaaaaggagaactccatcgacaactacctcttctcactatttagggactttaaaagtcttggaccaaaaaccttcacagaaacagagcatagaacctgatagagcagataacataagggcagctgtttatcaggagtggttagaaaagaaaaatgtgtatttacatgaaatgcacagaataaaaagaattgaaagtgaaaacttaaggatccaaaatgaacagaaaaaagctgctaaaagagaagaagcattagcatcatttgaggcctggaaggctatgaaagaaaaggaagcaaagaaaatagctgccaaaaagaggcttgaagaaaaaaacaagaagaaaactgaagaagaaaatgctgcaagaaaaggagaagcactacaagcttttgaaaaatggaaagagaaaaagatggaatatcttaaagagaaaaatagaaaggagagagaatatgaaagagcaaagaaacagaaagaggaggaaactgttgccgagaaaaagaaagataatttaactgctgttgagaaatggaatgaaaaaaaggaagcttttttcaagcaaaaggaaaaagaaaaaataaatgagaaaagaaaggaagaactgaaaagagctgagaaaaaagataaagataaacaagctattaatgaatatgaaaaatggctggaaaataaggaaaaacaagaaagaattgaacgaaaacagaagaaacgtcattcctttcttgaaagtgaggcacttcctccgtggagccctccaagcagaactgtgttcgcaaaagtgttttgataattctagttcttacattatttggttatttatcggtttgccaatattagccatagatttaaaaccattcaattatttatagttagaggaatatattttaattaaatgccagacactcctgctgacaatgaaagaaatactttggaatgtaatcagtgaaagcatttttttgaactgtagataaactgcctcaaacaaagacctaataatcagattgtttttaccattaagatacataagattttatcatgtcctgataattcttatggtggagtgattcatgatctttttcattaagctctgtatgttatttaagtatatttaattccagtaataaaaaggaaatcatctaggtaccataatgatagaaattattccttttgtggatgattgtgaatctagattcaggtttttaaatgaagggtcgctgggaagtgcgcatatattattccttctgaaactgatgtttagctcaaagcagttgcatttgtactgtgctagttagaattttcatcagttgaggcagtagctcagtagaactctaatcatcaaggctttttatttaagaattttgccttatgttttaatatgagtgtactttatctgttccaggcttatgtgataatcataggtactttataatgagtccacctctgaaatttttctttctgaattctatctcactttattatttcagtgataccaaaagacatcaatgtcacagtagtgatatacttatgtattagttatggaaattccacaggagttcaaggtcattatcactataattattttcctgactaaagccataaaggtgatttaggcaattattgtcatcttagctagtcctgttttatagcttatattcagcagacagctgtatgggaaggtaaatatgttgacaatgtccacaaagcctttatttatttatttatttgatctctgcatgtcctcgtagtaactggtctcatacttgacctggtcatctggtttaagacagaccaagtgtatgctcacggagctgaaatgcattagtcagttgtgcaatgaggagatgatggatgagaatatatagttcctatttattgagcatctaatatataatctctactggacctttacaaatgtatttaacatctttacaacaacttttcagggtaggtgttaccggcttcatcttacatataaaaatactggcgctcagataaaccaagtaacttaccgtccatctggagtgtgcctgagttgagatcaaacgggattcagtacgtctgactgaatctgcctccttctgaaatctctatgctctttttcacacttctctgtagcctcagagactgccaagttctgtcaagacctctgcataatatcaacgttacaaacacgttttaacttttagagcctaaaatcatgtattgttatccaaagatgatctttctctacagaaatagctgcttgttcttagagatggtggaggtcattaaatctataaagtgagataaaaatccataagatttcatgagttactcaggcatcttataactactatcagaatatcagaaaactcagcaagttatgtgacaaaggctttgagatgatcactccagacgttccacatactgagcatcagccttcttgctgcagtgcatgtgcaagataagatgtcataggcagctttgtaagattgtatcagtgctatagacaattaagagaaatttcatagataaaactagaaccctttctatatggccagaactgtaatactttatgaaattgatctgattatcagcaatatgtagtatcagcatggaatttaggacctctcttactcattcctgtgtcccccatagtaccaaaaacagtgcctgccaaaatagattaaaagtgtttattgtattagctgtttagagctgaaaagatatttacaaattccagggaagtaaaaggaaaaaaactgaaaaaggtacagctacttttggggatgtgagatcatggatgtgtatcttatagatttcacattatttatttactttccattattttcttctacattatcatatttagtggctaaccattattacttcttaggttgttgtgagaaccgagttaattaatgtaaactatttgacacataataaggacttaaatgttcattgttgtcattattgatttattaccatgagccctacatttccccattcatgagtgtgcgaacattaacatagatagggttgataatggttatttgacattacacatttttaggaagaagaaatttctgtcttgctggccagtccaggctgtaacactcaaaaaaacaaaacaaaacaaaacaaaacaaaaaaacagaaagatgccttgtattagggccttcctaaaaagaaagctaagtaagtattaatttcttaggattgcttctgaggtaggatgaggtgtttgcatagacccaacaagtcattcacttcaaattttttttgtcttactatgataaataacatattatttcctgtttacagcaacctgcactgaaattaactagttgaataaaatcacctcttctagcacaaataaagctgagttcggggaggtgggtgaaaatacagtactgttgtttacttcctaagatccaagggagagaatcaagcttggtaatattctcttgaatatacatttacctatttaaaaggtatgattttcccatatttccttaggaagtatgtcatgtcaatatagatatttactcattaggtttacattaatttgtattataagggaatgtttaattcaaattaaggacattaaaagtatatagactttcatataaaagttccggttttataaattgcgttgatcacttaaagaatgcagagatctcaaagtaaagaaaacaaattttatgaatattttaaaacattacttaaaacaagtttccttagaaagcacatttgtggataaatttaaatattaatactaaataataaagtagtatacagaatttaaatttcataataatgaagaaagtggtaatgctatttaacttaaaagatgcaatatggcattttagatcaagaggttaaagttttcttaatgaaagaaagtaacgatttatgggataaaaatattccagtggtttgtatttgcttcatacttcaaaagtgttagtccatttattgtttaaagttatattgaaactgatattttcactgctgccaaagcagtacctgacagtagataggtatccacagtcttatgttccttagagttatagaactatgcctctgaaaggggttttaatactttaataaacctggcctaaactgttttatttctaagttgaagaaactgattgtcaagtactttgacttgtccaatctcatacaactaactatggtacatctagagttagatctcagtatcaggggtcccagttgtattctgctcaccattccacaatttcgatattgataaaactttcacactaacttttgaactgtggttattattaatttagttgattcatgtcctcttatttatctccttactcctccactgctgccttcataactgtccaccagatcaaagctatttgggtacctacactttaaagtgaggggaaataatgaagtttcttaaatcctgtgtcatggactaagatacaataaagaaaaggaatttcacaaagtaggggaaattacgtgttagttataatcattcccaagaataaactagtaaaagaaacttagatttccctaatttaatcttgactccgattttgatagtgctatataaaaaggtatttaaacccatatgcttccttttacataaaagaaagatatcaactttcctagtttgcatttacactggctaataggataataaaatgctgtgtaaatgttaaactggaagtttctctgagttatttttactttaaaatttcatgtgattatgccattttgaatatgtatattacatgtaattgtataatgttaactcgggtaggcaaaattcttggtattaaatttaggatgttttaaaaattattaagaagatattaatgtctgctttttgatagcatatattttcatgtaatgtttagtgtattaaaatcaaccattcaagatttattttattgggtgacactattgactgtgttccaaaatgcccatagtgttaggaaatgtggtgtgagttttatttgtgggctaaggataaaataatcatatgctaatataccttttattataaatgactaaaaatttggatataaaactgatgttttactacacaaattacagagagagataatataattatataattattaaataattagaaaatgcaaataagcaaaagtcacccatgttcccagttctcatctcctgaagatagttataactaacatattattttgtactcttcctgttaattagtttctagtgtactttctcctgtagctgaaattaagctgagaaaaaaggaagagatagttcctccctcctctttctctctcccactctgtctctctcctgtgctatctgtgtgtatatacaaatatgtatgcatatatatataatgatgtacataatatatataaaatacaaatactaatgtgcatattttcaaacatacacatattttttattatttgaaataagaatgagtcagactacatatttggtagccagatttttttcactcagtgatatatcatgaacatatttccatgctaatataattttctaataattttagatgctgtaactacaatttcattgttaatgggcaatttgttgctttacaaatggtaaattatatgataaataatatgatcattattcttgtagccaatatcattattagaaatgatggaccgcattaaagctataaaattaaataagaatttataaatgtaaggagttattcagacatcttgtatctagtattacaatatcagaaaactcagcaggttatatgacatatacactttgagatagtcactcagaggttttcacatacaggattaaccttgctgcagtgcgtgtgcaagattaaaaaagatgtcacgggtcactttgtaatgtcatatcgttgctgttgataaataaaggaaatgttataaataaaa

SEQ ID NO: 58 - DNA, 5681 bp, Homo sapiens
cttcctcccgaagacgctgtttcctagcaaccgccctccgcctctgttattagcccctcctcctcgctcggtccaggaccggctctgcgggcgccgccaggcccagaccaagctactatcagaagttgaattctaataattagctattttataaaggtaacgagaaaaaatacactatgtctgatgaagtttttagcaccactttggcatatacaaagagtccaaaagttaccaaaagaactactttccaggatgagctagtaagagcaattacagctcgctcagccagacaaaggagttctgaatactcagatgactttgacagtgatgagattgtttctttaggtgatttttctgacacttcagcagatgaaaattcagttaataaaaaaatgaatgactttcatatatcagatgatgaagaaaagaatccttcaaaactattgtttttgaaaaccaataaatcaaacggtaacataaccaaagatgagccagtgtgtgccatcaaaaatgaagaggaaatggcacctgatgggtgtgaagacattgttgtaaaatctttctctgaatctcaaaataaggatgaggaatttgaaaaagacaaaataaaaatgaaacctaaacccagaattctttcaattaaaagcacatcttcagcagaaaacaacagccttgacacagatgatcactttaaaccatcacctcggccaaggagtatgttgaaaaagaaaagtcacatggaggagaaggatggactagaagataaagaaactgccctcagtgaagaattggagttacattctgcaccttcttcccttccaacgccgaatggcatacaattagaagctgagaaaaaagcattctctgaaaaccttgatcctgaggattcatgcttaacaagtctagcatcatcatcacttaaacaaattcttggagattctttttcaccaggatctgagggaaacgcatctggaaaagatccaaatgaagaaatcactgaaaaccataattccttgaaatcagatgaaaataaagagaattcattttcagcagaccatgtgactactgcagttgagaaatccaaggaaagtcaagtgactgctgatgaccttgaagaagaaaaggcaaaagcggaactgattatggatgatgacagaacagttgatccactactatctaaatctcagagtatcttaatatctaccagtgcaacagcatcttcaaagaaaacaattgaagatagaaatataaagaataaaaagtcaacaaataatagagcatccagtgcatctgccagattaatgacctctgagtttttgaagaaatctagttctaaaaggagaactccatcgacaactacctcttctcactatttagggactttaaaagtcttggaccaaaaaccttcacagaaacagagcatagaacctgatagagcagataacataagggcagctgtttatcaggagtggttagaaaagaaaaatgtgtatttacatgaaatgcacagaataaaaagaattgaaagtgaaaacttaaggatccaaaatgaacagaaaaaagctgctaaaagagaagaagcattagcatcatttgaggcctggaaggctatgaaagaaaaggaagcaaagaaaatagctgccaaaaagaggcttgaagaaaaaaacaagaagaaaactgaagaagaaaatgctgcaagaaaaggagaagcactacaagcttttgaaaaatggaaagagaaaaagatggaatatcttaaagagaaaaatagaaaggagagagaatatgaaagagcaaagaaacagaaagaggaggaaactgttgccgagaaaaagaaagataatttaactgctgttgagaaatggaatgaaaaaaaggaagcttttttcaagcaaaaggaaaaagaaaaaataaatgagaaaagaaaggaagaactgaaaagagctgagaaaaaagataaagataaacaagctattaatgaatatgaaaaatggctggaaaataaggaaaaacaagaaagaattgaacgaaaacagaagaaacgtcattcctttcttgaaagtgaggcacttcctccgtggagccctccaagcagaactgtgttcgcaaaagtgttttgataattctagttcttacattatttggttatttatcggtttgccaatattagccatagatttaaaaccattcaattatttatagttagaggaatatattttaattaaatgccagacactcctgctgacaatgaaagaaatactttggaatgtaatcagtgaaagcatttttttgaactgtagataaactgcctcaaacaaagacctaataatcagattgtttttaccattaagatacataagattttatcatgtcctgataattcttatggtggagtgattcatgatctttttcattaagctctgtatgttatttaagtatatttaattccagtaataaaaaggaaatcatctaggtaccataatgatagaaattattccttttgtggatgattgtgaatctagattcaggtttttaaatgaagggtcgctgggaagtgcgcatatattattccttctgaaactgatgtttagctcaaagcagttgcatttgtactgtgctagttagaattttcatcagttgaggcagtagctcagtagaactctaatcatcaaggctttttatttaagaattttgccttatgttttaatatgagtgtactttatctgttccaggcttatgtgataatcataggtactttataatgagtccacctctgaaatttttctttctgaattctatctcactttattatttcagtgataccaaaagacatcaatgtcacagtagtgatatacttatgtattagttatggaaattccacaggagttcaaggtcattatcactataattattttcctgactaaagccataaaggtgatttaggcaattattgtcatcttagctagtcctgttttatagcttatattcagcagacagctgtatgggaaggtaaatatgttgacaatgtccacaaagcctttatttatttatttatttgatctctgcatgtcctcgtagtaactggtctcatacttgacctggtcatctggtttaagacagaccaagtgtatgctcacggagctgaaatgcattagtcagttgtgcaatgaggagatgatggatgagaatatatagttcctatttattgagcatctaatatataatctctactggacctttacaaatgtatttaacatctttacaacaacttttcagggtaggtgttaccggcttcatcttacatataaaaatactggcgctcagataaaccaagtaacttaccgtccatctggagtgtgcctgagttgagatcaaacgggattcagtacgtctgactgaatctgcctccttctgaaatctctatgctctttttcacacttctctgtagcctcagagactgccaagttctgtcaagacctctgcataatatcaacgttacaaacacgttttaacttttagagcctaaaatcatgtattgttatccaaagatgatctttctctacagaaatagctgcttgttcttagagatggtggaggtcattaaatctataaagtgagataaaaatccataagatttcatgagttactcaggcatcttataactactatcagaatatcagaaaactcagcaagttatgtgacaaaggctttgagatgatcactccagacgttccacatactgagcatcagccttcttgctgcagtgcatgtgcaagataagatgtcataggcagctttgtaagattgtatcagtgctatagacaattaagagaaatttcatagataaaactagaaccctttctatatggccagaactgtaatactttatgaaattgatctgattatcagcaatatgtagtatcagcatggaatttaggacctctcttactcattcctgtgtcccccatagtaccaaaaacagtgcctgccaaaatagattaaaagtgtttattgtattagctgtttagagctgaaaagatatttacaaattccagggaagtaaaaggaaaaaaactgaaaaaggtacagctacttttggggatgtgagatcatggatgtgtatcttatagatttcacattatttatttactttccattattttcttctacattatcatatttagtgtctaaccattattacttcttaggttgttgtgagaaccgagttaattaatgtaaactatttgacacataataaggacttaaatgttcattgttgtcattattgatttattaccatgagccctacatttccccattcatgagtgtgcgaacattaacatagatagggttgataatggttatttgacattacacatttttaggaagaagaaatttctgtcttgctggccagtccaggctgtaacactcaaaaaaacaaaacaaaacaaaacaaaacaaaaaaacagaaagatgccttgtattagggccttcctaaaaagaaagctaagtaagtattaatttcttaggattgcttctgaggtaggatgaggtgtttgcatagacccaacaagtcattcacttcaaattttttttgtcttactatgataaataacatattatttcctgtttacagcaacctgcactgaaattaactagttgaataaaatcacctcttctagcacaaataaagctgagttcggggaggtgggtgaaaatacagtactgttgtttacttcctaagatccaagggagagaatcaagcttggtaatattctcttgaatatacatttacctatttaaaaggtatgattttcccatatttccttaggaagtatgtcatgtcaatatagatatttactcattaggtttacattaatttgtattataagggaatgtttaattcaaattaaggacattaaaagtatatagactttcatataaaagttccggttttataaattgcgttgatcacttaaagaatgcagagatctcaaagtaaagaaaacaaattttatgaatattttaaaacattacttaaaacaagtttccttagaaagcacatttgtggataaatttaaatattaatactaaataataaagtagtatacagaatttaaatttcataataatgaagaaagtggtaatgctatttaacttaaaagatgcaatatggcattttagatcaagaggttaaagttttcttaatgaaagaaagtaacgatttatgggataaaaatattccagtggtttgtatttgcttcatacttcaaaagtgttagtccatttattgtttaaagttatattgaaactgatattttcactgctgccaaagcagtacctgacagtagataggtatccacagtcttatgttccttagagttatagaactatgcctctgaaaggggttttaatactttaataaacctggcctaaactgttttatttctaagttgaagaaactgattgtcaagtactttgacttgtccaatctcatacaactaactatggtacatctagagttagatctcagtatcaggggtcccagttgtattctgctcaccattccacaatttcgatattgataaaactttcacactaacttttgaactgtggttattattaatttagttgattcatgtcctcttatttatctccttactcctccactgctgccttca

SEQ ID NO: 59 - protein, 647 aa, Homo sapiens
MSDEVFSTTLAYTKSPKVTKRTTFQDELIRAITARSARQRSSEYSDDFDSDEIVSLGDFSDTSADENSVNKKMNDFHISDDEEKNPSKLLFLKTNKSNGNITKDEPVCAIKNEEEMAPDGCEDIVVKSFSESQNKDEEFEKDKIKMKPKPRILSIKSTSSAENNSLDTDDHFKPSPRPRSMLKKKSHMEEKDGLEDKETALSEELELHSAPSSLPTPNGIQLEAEKKAFSENLDPEDSCLTSLASSSLKQILGDSFSPGSEGNASGKDPNEEITENHNSLKSDENKENSFSADHVTTAVEKSKESQVTADDLEEEKAKAELIMDDDRTVDPLLSKSQSILISTSATASSKKTIEDRNIKNKKSTNNRASSASARLMTSEFLKKSSSKRRTPSTTTSSHYLGTLKVLDQKPSQKQSIEPDRADNIRAAVYQEWLEKKNVYLHEMHRIKRIESENLRIQNEQKKAAKREEALASFEAWKAMKEKEAKKIAAKKRLEEKNKKKTEEENAARKGEALQAFEKWKEKKMEYLKEKNRKEREYERAKKQKEEETVAEKKKDNLTAVEKWNEKKEAFFKQKEKEKINEKRKEELKRAEKKDKDKQAINEYEKWLENKEKQERIERKQKKRHSFLESEALPPWSPPSRTVFAKVF

SEQ ID NO: 60 - protein, 647 aa, Homo sapiens [sequence omitted]

SEQ ID NO: 61 - DNA, 2847 bp, Homo sapiens
agggcagcgcgtgtcggcgtccggaggaggtgacctagccgccgcggtcctagaagggagaagtggagagagaccgctggcaggatggcagcagatgaaagctcacagaacactttgcggctccagttcaaggcaatgcaggagatgcagcacaaacggttacagaagcagatggagaaaaagagggaaaaagaactgagcctcaaaagcagagctgacgaccaagaggagcccttggaggtttcagatggcctcagccttctccacgcaggggagccaaactcgaaaaatagctttgagaagagggtgcttgaagatgagattgaacaccttcgaaatgagctcagggaaacggtggacgagaacgggcgattgtataagctgctgaaggaaagggactttgaaatcaaacacctcaaaaagaaaatagaagaggacagatttgccttcacagggacagccggtgtagccggagacgtggtcgccaccaaaattgtggagctatcaaaaaagaaccggctgttgatggcagaatcagagggtgcaaaaaccagggtgaagcagctgaccaatcgcatccaggagctggagcgggaactgcagacagccctgaccaggctgtcagccaagggggccaccgacgcaggagccaagccaccgagggcccagatgggagacagagcattgctggagaccccagaggtgaaggccctgcaggacaggctggtggccaccaacttgaagatgagtgacctccgaaaccagatccagtctgtgaagcaggagctgcggatggcacagaaggttttggccagagaggttggggaagacatcaacgttcagcagctcctatcttcgccagggacctggaggggtcgggctcaacaaattcttgttttgcagagcaaggttcaagagcttgagaagcaattgggccaggcccggagccagtctgcgggaacagccagtgatgagttgtctgtctatccagacccaaggaagctgtcggcacaggagaaaaacctgctgaggatccgcagcctggaaagggaaaaacaggaaggcttggagaaacttgccagtgaacgggatgtcctccagagagagcttgaagagctaaaaaagaagttcgagggcatgaggtctcggaacaagctgctgtcaagtgagatgaagaccctcaagagtcagatgggaaccctggtggagaagggccggcatgatgacgagctcatcgacgccctcatggaccagctgaagcagctacaggagatcctaggcagcctgagtctgcaggaggagaaaacgcgagtgtcccagcaccacctggaccagcaactgaacagcgaggctcagcggagcaacagcctagtcgcccagctgcaggccatggtagctgagcgggaggccaaagtgcgacagctggagatggagatcggacaactcaatgtgcactatcttcggaataaaggagtgggtgaggggtccagtggccgcgaggtcagccctgcctatacccagttcctggaggacccaggcctgaccaagtccccggcctcagcaggcgatcatgttggcaggcttggatcttctcgctctgtgaccagcctgggccacacactggtggaatctgctctcacgaggccttccctgcccagtccccacaggacctcacctaggttctcggactccccagaacaaaaaggctggcaggcacaagtgtcagagatcaaggccctctggcaggctgccgaggtggagcgtgaccggctcaccgagtttgtcactgtcctgcagaaacgggtggaggagagcaacagcaagctcctggagtcagagaggaagctgcaggaggagcgacaccgcaccgtggtgctggagcaacatctggagaagatacgcctggagccagggaaggcatcagcctcccagagagcagctcccaggaccaaaacaggtctgcccacctctaacaacaggcacaacccaaccgggagcgagaagaaggacccatcctttgcccagctctccgatgtgcccgtggaatcccaaatggaagagctgacaaccaggctggccatccaggtggaggagaatgaaatgctaaaggctgccctgggcagtgccctgcggggaaaggaggaggacttccggatgtaccatgagatcctgggccaggtgaaaagtgtcttcctgcaggccctgcggcagcagaagacaggcaagcaataggatgacagcccagtgtcggcctggccgggtgggcagcctcaggtcttgagaggataagactctgtctgaggactccatctgctccgggaagccagcccagggcagccagctcaaccacttctaccagaagaggctccttaaggatgaccaaaaccaatgtctcaggccaggaaggcagaagagaagccctggtgggacactgcaggagaccctgggctggctgggttacagcagcagggaggcccagcagcccactggcagaggcgagagctctgggatggcaaggcggctgtgaatggacagatgcagtccctcgggcaggtgttcatcgccctcatcctaggtactagccctggatgtccccatggcttcacacacagaagagcccttggttaccctaagtgggcatatcccccatgccactcagccctgccctatcccctcacccccatcccggctccatctgtagccgtccacaccctacacagacttggggcactatgctctcaaccagtttgtcagcccactcctcaggacacttcctcaggtgcagacccttggacttgtaataataataagtattttcataatcactgcaaaaaaaaaaaaaaaaaa

SEQ ID NO: 62 - DNA, 2841 bp, Homo sapiens
tgtgggcagcgcgtgtcggcgtccggaggaggtgacctagccgccgcggtcctagaagggagaagtggagagagaccgctggcaggatggcagcagatgaaagctcacagaacactttgcggctccagttcaaggcaatgcaggagatgcagcacaaacggttacagaagcagatggagaaaaagagggaaaaagaactgagcctcaaaagcagagctgacgaccaagaggagcccttggaggtttcagatggcctcagccttctccacgcaggggagccaaactcgaaaaatagctttgagaagagggtgcttgaagatgagattgaacaccttcgaaatgagctcagggaaacggtggacgagaacgggcgattgtataagctgctgaaggaaagggactttgaaatcaaacacctcaaaaagaaaatagaagaggacagatttgccttcacagggacagccggtgtagccggagacgtggtcgccaccaaaattgtggagctatcaaaaaagaaccggctgttgatggcagaatcagagggtgcaaaaaccagggtgaagcagctgaccaatcgcatccaggagctggagcgggaactgcagacagccctgaccaggctgtcagccaagggggccaccgacgcaggagccaagccaccgagggcccagatgggagacagagcattgctggagaccccagaggtgaaggccctgcaggacaggctggtggccaccaacttgaagatgagtgacctccgaaaccagatccagtctgtgaagcaggagctgcggatggcacagaaggttttggccagagaggttggggaagacatcaacgttcagcagctcctatcttcgccagggacctggaggggtcgggctcaacaaattcttgttttgcagagcaaggttcaagagcttgagaagcaattgggccaggcccggagccagtctgcgggaacagccagtgatgagttgtctgtctatccagacccaaggaagctgtcggcacaggagaaaaacctgctgaggatccgcagcctggaaagggaaaaacaggaaggcttggagaaacttgccagtgaacgggatgtcctccagagagagcttgaagagctaaaaaagaagttcgagggcatgaggtctcggaacaagctgctgtcaagtgagatgaagaccctcaagagtcagatgggaaccctggtggtgaagggccggcatgatgacgagctcatcgacgccctcatggaccagctgaagcagctacaggagatcctaggcagcctgagtctgcaggaggagaaaacgcgagtgtcccagcaccacctggaccagcaactgaacagcgaggctcagcggagcaacagcctagtcgcccagctgcaggccatggtagctgagcgggaggccaaagtgcgacagctggagatggagatcggacaactcaatgtgcactatcttcggaataaaggagtgggtgaggggtccagtggccgcgaggtcagccctgcctatacccagttcctggaggacccaggcctgaccaagtccccggcctcagcaggcgatcatgttggcaggcttggatcttctcgctctgtgaccagcctgggccacacactggtggaatctgctctcacgaggccttccctgcccagtccccacaggacctcacctaggttctcggactccccagaacaaaaaggctggcaggcacaagtgtcagagatcaaggccctctggcaggctgccgaggtggagcgtgaccggctcaccgagtttgtcactgtcctgcagaaacgggtggaggagagcaacagcaagctcctggagtcagagaggaagctgcaggaggagcgacaccgcaccgtggtgctggagcaacatctggagaagatacgcctggagccagggaaggcatcagcctcccagagagcagctcccaggaccaaaacaggtctgcccacctctaacaacaggcacaacccaaccgggagcgagaagaaggacccatcctttgcccagctctccgatgtgcccgtggaatcccaaatggaagagctgacaaccaggctggccatccaggtggaggagaatgaaatgctaaaggctgccctgggcagtgccctgcggggaaaggaggaggacttccggatgtaccatgagatcctgggccaggtgaaaagtgtcttcctgcaggccctgcggcagcagaagacaggcaagcaataggatgacagcccagtgtcggcctggccgggtgggcagcctcaggtcttgagaggataagactctgtctgaggactccatctgctccgggaagccagcccagggcagccagctcaaccacttctaccagaagaggctccttaaggatgaccaaaaccaatgtctcaggccaggaaggcagaagagaagccctggtgggacactgcaggagaccctgggctggctgggttacagcagcagggaggcccagcagcccactggcagaggcgagagctctgggatggcaaggcggctgtgaatggacagatgcagtccctcgggcaggtgttcatcgccctcatcctaggtactagccctggatgtccccatggcttcacacacagaagagcccttggttaccctaagtgggcatatcccccatgccactcagccctgccctatcccctcacccccatcccggctccatctgtagccgtccacaccctacacagacttggggcactatgctctcaaccagtttgtcagcccactcctcaggacacttcctcaggtgcagacccttggacttgtaataataataagtattttcataaccaaaaaaaaaaaaaaa

SEQ ID NO: 63 - protein, 715 aa, Homo sapiens
MAADESSQNTLRLQFKAMQEMQHKRLQKQMEKKREKELSLKSRADDQEEPLEVSDGLSLLHAGEPNSKNSFEKRVLEDEIEHLRNELRETVDENGRLYKLLKERDFEIKHLKKKIEEDRFAFTGTAGVAGDVVATKIVELSKKNRLLMAESEGAKTRVKQLTNRIQELERELQTALTRLSAKGATDAGAKPPRAQMGDRALLETPEVKALQDRLVATNLKMSDLRNQIQSVKQELRMAQKVLAREVGEDINVQQLLSSPGTWRGRAQQILVLQSKVQELEKQLGQARSQSAGTASDELSVYPDPRKLSAQEKNLLRIRSLEREKQEGLEKLASERDVLQRELEELKKKFEGMRSRNKLLSSEMKTLKSQMGTLVEKGRHDDELIDALMDQLKQLQEILGSLSLQEEKTRVSQHHLDQQLNSEAQRSNSLVAQLQAMVAEREAKVRQLEMEIGQLNVHYLRNKGVGEGSSGREVSPAYTQFLEDPGLTKSPASAGDHVGRLGSSRSVTSLGHTLVESALTRPSLPSPHRTSPRFSDSPEQKGWQAQVSEIKALWQAAEVERDRLTEFVTVLQKRVEESNSKLLESERKLQEERHRTVVLEQHLEKIRLEPGKASASQRAAPRTKTGLPTSNNRHNPTGSEKKDPSFAQLSDVPVESQMEELTTRLAIQVEENEMLKAALGSALRGKEEDFRMYHEILGQVKSVFLQALRQQKTGKQ

SEQ ID NO: 64 - protein, 715 aa, Homo sapiens
MAADESSQNTLRLQFKAMQEMQHKRLQKQMEKKREKELSLKSRADDQEEPLEVSDGLSLLHAGEPNSKNSFEKRVLEDEIEHLRNELRETVDENGRLYKLLKERDFEIKHLKKKIEEDRFAFTGTAGVAGDVVATKIVELSKKNRLLMAESEGAKTRVKQLTNRIQELERELQTALTRLSAKGATDAGAKPPRAQMGDRALLETPEVKALQDRLVATNLKMSDLRNQIQSVKQELRMAQKVLAREVGEDINVQQLLSSPGTWRGRAQQILVLQSKVQELEKQLGQARSQSAGTASDELSVYPDPRKLSAQEKNLLRIRSLEREKQEGLEKLASERDVLQRELEELKKKFEGMRSRNKLLSSEMKTLKSQMGTLVVKGRHDDELIDALMDQLKQLQEILGSLSLQEEKTRVSQHHLDQQLNSEAQRSNSLVAQLQAMVAEREAKVRQLEMEIGQLNVHYLRNKGVGEGSSGREVSPAYTQFLEDPGLTKSPASAGDHVGRLGSSRSVTSLGHTLVESALTRPSLPSPHRTSPRFSDSPEQKGWQAQVSEIKALWQAAEVERDRLTEFVTVLQKRVEESNSKLLESERKLQEERHRTVVLEQHLEKIRLEPGKASASQRAAPRTKTGLPTSNNRHNPTGSEKKDPSFAQLSDVPVESQMEELTTRLAIQVEENEMLKAALGSALRGKEEDFRMYHEILGQVKSVFLQALRQQKTGKQ

SEQ ID NO: 65 - DNA, 5293 bp, Homo sapiens
aatcatttcaattatatctacatcaaataaaataaaaatgagtgaagcccccagattcttcgttggaccagaagatacagaaataaatcctggaaattatcgacatttcttccaccatgcagatgaagacgatgaggaggaagatgattctccaccagaaaggcagattgtggttggaatatgttccatggcaaagaaatccaaatccaaaccaatgaaggaaattcttgaacggatctccttatttaaatatatcacagtagtagtatttgaagaggaggttattttgaatgaaccagtggaaaactggcctttatgtgattgtcttatttctttccattctaaaggatttccactggacaaagcggttgcctatgcaaaactcaggaatccatttgtaatcaatgacttgaatatgcagtatctcatacaagataggagagaagtatatagtattcttcaagctgaaggtattttacttcctcgttatgctattttgaaccgtgacccaaataatcccaaagaatgtaatctgattgaaggggaagatcatgtagaagtaaatggggaagtttttcaaaagccatttgtagaaaagccagtcagtgcagaagatcacaatgtttacatttattacccaacttctgctggtggtggaagtcaaagactctttagaaagattggcagtagaagtagtgtttattctccagaaagcaatgtacgaaaaacaggctcatatatatatgaagagtttatgcccacagatggtactgatgttaaggtttatacagtgggtccagattatgcccatgctgaagctcgaaaatctccagcacttgatggcaaggtggaacgagacagtgaaggaaaagaagtaagataccctgttattctcaatgcacgagagaaattaattgcttggaaagtctgccttgcttttaagcaaacagtttgtggctttgatttgttacgggccaatggacagtcctatgtctgtgatgtcaatggcttcagttttgtgaaaaattccatgaagtattatgatgactgtgcaaaaatacttggaaatattgtaatgcgagaacttgctccacaatttcatattccatggtcaatacccttagaagctgaagatatcccaattgtaccaactacatctggaactatgatggaacttagatgtgtcatagctgttatacgtcatggggatcgaacaccaaaacaaaaaatgaaaatggaagtgagacatcagaaattttttgatctttttgaaaagtgtgatggatataaatcagggaaattaaaactcaaaaaaccaaaacagttacaggaagtgctagatattgcacgacagcttcttatggagctagggcaaaataatgattctgaaattgaagaaaacaagccaaaacttgaacaacttaagactgtattagagatgtatggtcatttttctggaataaatcgtaaggttcagttgacctatctccctcatggttgtcctaaaacatctagtgaagaggaggacagccgaagagaagaaccatctttacttttggttctaaaatggggaggtgaattaactcctgcaggcagggtccaggctgaagaacttggaagagccttcaggtgtatgtatcctggaggtcaaggagattatgcaggatttcctggttgtggtttacttagattacatagcacctacagacatgacctcaaaatatatgcctctgatgaaggacgagtccagatgactgcagctgcttttgcaaaggggcttttagctttggaaggagagcttacacccattcttgttcaaatggtgaaaagtgcaaatatgaacggtcttttggatagtgatagtgactctctgagcagttgtcagcaacgtgtgaaggcaaggcttcatgaaatacttcagaaagacagagattttactgctgaagattatgaaaagcttactccatctggaagcatttctcttatcaaatcaatgcatttaattaaaaaccctgtgaagacctgtgataaagtttattccttaattcagagtttgacttctcaaatcagacatcgaatggaagatcctaaatcatcagatattcagctttaccatagtgaaacattggagcttatgctacgtagatggtccaagttagagaaagactttaaaacaaagaatggaagatatgatattagtaaaatccctgacatatatgactgtataaaatatgatgtccagcataatggttccttgaaattagaaaacacaatggaattatataggctttcgaaggcattagcagatattgttatccctcaggaatatggtataactaaagctgaaaaactggagattgccaaaggctactgtactcctctggttagaaaaattcgctcagaccttcagaggacacaagatgatgacactgtaaataaacttcatcctgtgtattctagaggtgttctgtctcctgaacgtcatgttcgtactagattatattttaccagtgaaagtcatgtacattctttgctgtctattcttcgctatggtgccttatgcaatgaatcaaaggatgaacagtggaaacgagctatggattatttaaacgttgtcaatgagctcaactacatgactcagattgttatcatgctttatgaggatcctaataaggatctttcctcagaagaacgctttcatgttgaattacactttagtccgggagccaaaggttgtgaagaagacaaaaatttgccatctggctatggatatagaccagcttccagagagaatgaaggcaggagaccttttaaaattgataatgatgatgaaccacatacttctaaaagagatgaagttgatcgagctgtgatattgtttaaaccaatggtatcagagccaattcatatacacaggaagtctccacttccaagatctaggaagacggctacaaatgatgaagagagccccctgagtgtgtctagcccagagggtactggtacctggctgcattataccagtggtgtgggtactgggcgtcgaagacgcagatcaggggaacaaatcacttcttcccctgtctcccccaaatcattggctttcacatccagtatttttggctcatggcaacaggttgtatctgaaaatgctaattacctgcgaacaccaagaactcttgtggaacagaagcagaatcctactgtagggtctcactgtgcgggcctgtttagcacctcggtgctcgggggttcttcaagcgcacctaacctacaggattatgctcgtactcatcgtaaaaagctgacctcttctggctgcatagatggctttgaattgtattccatggtgccatctatttgtcctctagaaactcttcataatgccctatctttaaagcaagtggatgaatttcttgcttccattgcttctccatcatctgacgttccacggaagaccgctgaaatttcctctacagctttacgttccagtccaataatgagaaaaaaagtatctttaaatacgtatacacctgcaaagatcctcccaacaccaccagctaccttaaagagcactaaagcaagcagcaaaccagctacaagtggaccttctagtgcagttgttcctaatacctcatctcggaaaaagaatataactagcaaaacagaaacgcatgaacacaaaaaaaacactgggaaaaagaaatgaaatcttagcagaagctggaactttttatacttataaaaatagtgtgttcttatgtttctccttatgcatttatgtgttcacttaaaaatgtttttaaatctaaggttttctttgtttatgttcaggtaaggaactgttgtcatgatctggaaatgtttaaaacaatgtttgttagcattctgtgagcagcaaaacttatagtgataaaaatcgattgttgttaatatgatgtttaccatgtgcacatagtaatgaaaaggaacataaaagcccagcaggctcgtaccaaagtcacagcagtaatgctatgtactgcagagtctgatgagctggcctttgtgcacacttttattttcatgggattgcatcttagctgttaaaacttctagattgaaatttgacagccagggttacatattggggacttttaaagtgtctttccaaagagatttcattaaccgtttagattagaatatctttcccaattgttacagtgacatatatgctgcaatatttaacaactggagtattagccacatgggttattttttcaatctgtgttttgaatttttttattgtgtgttatttaaaatattacatatgcagctgggagaactacacctttgtgcacatagatttatatattaatttgtagaaaatattttctttatatatttccttaccatacaaggtgccttgttcatcaggaaaacttttgttttgtattttgacaagaaaggcaccttcagagtttctttttaagtatagttgacaagtgtataaatgttacacttactttcagagttctttttagatctaaagaagtcagttcaaaaatggaaatcaacaatgttaggagaaatctgaattctgttaagttagtaagtattatgtatagcatctgtttttaaccatttccattcttatccctagtgtatcagttgatcacactaagaaagcttaaagattgagcatttgaaataaatgctctttataaatgattagatttttgaagggatattgaaatcattgcgctgtgatttcatctgtgatgtgaaaaatcaatttattatccttggtgctttcccccccaccaatgcacaaataattgtgaacagcttgaaatgacttaaactgtaatccaaatgggacaatctgataagaatttcatgcattggtagttaaataacttaaattgctaaagctttagcttgaaatttatgtttagaaaaactattgatttcccatggtatgaatataactattgtaattcttcaaatgagactcttctcaccttaaatagtcatatattaattaacttataggaaataagcatactatatgttagctgttttaaaaggtaccagatgtaagagtcataaatatatgcaattaaagaagttcatagatttcacacgaatgtaaatgtgttatatggagacatgtcttgtaaacagttgaatgtatgtaagttttctgtttgtgaaaatgtagttaatgtactcactgtggaggtcataaggaagctactttttttttaaagtggaacctaattaaaatatttccagaatcaaaaaaaaaaaaaaa

SEQ ID NO: 66 - protein, 1222 aa, Homo sapiens
MSEAPRFFVGPEDTEINPGNYRHFFHHADEDDEEEDDSPPERQIVVGICSMAKKSKSKPMKEILERISLFKYITVVVFEEEVILNEPVENWPLCDCLISFHSKGFPLDKAVAYAKLRNPFVINDLNMQYLIQDRREVYSILQAEGILLPRYAILNRDPNNPKECNLIEGEDHVEVNGEVFQKPFVEKPVSAEDHNVYIYYPTSAGGGSQRLFRKIGSRSSVYSPESNVRKTGSYIYEEFMPTDGTDVKVYTVGPDYAHAEARKSPALDGKVERDSEGKEVRYPVILNAREKLIAWKVCLAFKQTVCGFDLLRANGQSYVCDVNGFSFVKNSMKYYDDCAKILGNIVMRELAPQFHIPWSIPLEAEDIPIVPTTSGTMMELRCVIAVIRHGDRTPKQKMKMEVRHQKFFDLFEKCDGYKSGKLKLKKPKQLQEVLDIARQLLMELGQNNDSEIEENKPKLEQLKTVLEMYGHFSGINRKVQLTYLPHGCPKTSSEEEDSRREEPSLLLVLKWGGELTPAGRVQAEELGRAFRCMYPGGQGDYAGFPGCGLLRLHSTYRHDLKIYASDEGRVQMTAAAFAKGLLALEGELTPILVQMVKSANMNGLLDSDSDSLSSCQQRVKARLHEILQKDRDFTAEDYEKLTPSGSISLIKSMHLIKNPVKTCDKVYSLIQSLTSQIRHRMEDPKSSDIQLYHSETLELMLRRWSKLEKDFKTKNGRYDISKIPDIYDCIKYDVQHNGSLKLENTMELYRLSKALADIVIPQEYGITKAEKLEIAKGYCTPLVRKIRSDLQRTQDDDTVNKLHPVYSRGVLSPERHVRTRLYFTSESHVHSLLSILRYGALCNESKDEQWKRAMDYLNVVNELNYMTQIVIMLYEDPNKDLSSEERFHVELHFSPGAKGCEEDKNLPSGYGYRPASRENEGRRPFKIDNDDEPHTSKRDEVDRAVILFKPMVSEPIHIHRKSPLPRSRKTATNDEESPLSVSSPEGTGTWLHYTSGVGTGRRRRRSGEQITSSPVSPKSLAFTSSIFGSWQQVVSENANYLRTPRTLVEQKQNPTVGSHCAGLFSTSVLGGSSSAPNLQDYARTHRKKLTSSGCIDGFELYSMVPSICPLETLHNALSLKQVDEFLASIASPSSDVPRKTAEISSTALRSSPIMRKKVSLNTYTPAKILPTPPATLKSTKASSKPATSGPSSAVVPNTSSRKKNITSKTETHEHKKNTGKKK

SEQ ID NO: 67 - DNA, 1263 bp, Homo sapiens
tgtgtgggcaccagagggtgaactgaggtctgagggtcgggacacaggccgggaacagcagctgggagcggagcacgggggaaacgtggatgcgctgagctccctacaaccgcagtgagcatgtgcccaggagggcctcacggggtgggtgtgagtctggcctgcctgggctcggggtggggggtgtttacagacgcatttcagccccgcagcaggggctggggaggtcccgctcgtgacagtctctgcaccaaggcaggagagatggaagccgcccagagaactgccactccatagcctgtgggcatccaggggtgagcggcagcgatggcgtcccatggaggaaacacactggaaatcgtgcagaagatgggaagatgcaggctggagtgcggagaaggactgagaccctgcctggtagacggcaccgtcacagcagccgtctgcctgctaggaggctccgctccttgccttcagtctgcaccagcatgttcagtgactgcatcagggcgcgctgcgccaccctcttctcctcatccaggagcgtctccaccagcagcaggccggcccctgagggagacagcagagagctggagtcctggccagccaggcggggatccttcagcaggacacaggggacacagcaggcaacaggagctcagaacgctccaggaggcgtgtcgggaacggaggcagggtctcccgagtcctgtgacactcagcctctgccgtggcctgtcccgcctctcccgcctcggccttctcatcgcggctgcccgcgtccctctgagtgggctccgagccgcccccctccacgtcactgaggtcttcgaaggtgtccgcggccgggatggggtcgtgcttgacactccgccgcaggtcctccggacggggcgggtagtagagcttcaccagctgcttgcagaagtggttcagcgggaatcccaccacgttcagaaagtccccgtgtacggactccaccagcatgccgcccagggcctggatcccgtagccgccagctttgtccctgggtgggcaggggaagagcagctcctcggacagctccgagaacttcaccttcgtttcctcgtagaattccgagaccctggtgtccagctgatggtctgcaaggacacagccgtgggggtgagcgtggacgccagcttgtcacctccgtgccctgacagctgcgtggctgtgctgtggaggtgtgtactcgagcgcagcgcacagttcagatatggatgcttcatgggagaataa

SEQ ID NO: 68 - protein, 311 aa, Homo sapiens
MASHGGNTLEIVQKMGRCRLECGEGLRPCLVDGTVTAAVCLLGGSAPCLQSAPACSVTASGRAAPPSSPHPGASPPAAGRPLRETAESWSPGQPGGDPSAGHRGHSRQQELRTLQEACRERRQGLPSPVTLSLCRGLSRLSRLGLLIAAARVPLSGLRAAPLHVTEVFEGVRGRDGVVLDTPPQVLRTGRVVELHQLLAEVVQRESHHVQKVPVYGLHQHAAQGLDPVAASFVPGWAGEEQLLGQLRELHLRFLVEFRDPGVQLMVCKDTAVGVSVDASLSPPCPDSCVAVLWRCVLERSAQFRYGCFMGE

SEQ ID NO: 69 - DNA, 1670 bp, Homo sapiens
aatggggacctggaacctgggcttactagagtgccgcgcgtagggctccaggtcgctggcttctgcgcttccttcctctccaaagttgagtatctcctatctgtgtcctcgtacatactgccgcctgaggtgccatggcccccaagccgggggccgagtggagcacagccctgtcccatctggtgctgggagtggtgtctctgcacgcagccgtgagcacagccgaggcaagtcgaggggctgctgctggcttcctgctccaggtcttggctgccaccaccacgctggccccagggctgagcacacacgaagactgccttgctggagcctgggtggccaccgtcatcggccttccccttctggccttcgatttccactggtgtactaatggtcacttgatgtgcgctggctgttttatccacctactagcagatgcccggctgaaggaggagcaggccacgtgccccaattgtcgttgtgagatcagtaagagcctctgctgccggaacctggccgtggagaaagccgtgagcgagctgccttcagagtgtggcttctgcctgcgccagtttccccgctccctcctggagaggcaccagaaagaggaatgccaggacagggtaacccagtgcaagtacaaacgcatcggctgcccatggcacggccccttccatgagctgacggtgcacgaggctgcgtgcgcccacccgaccaagacaggcagtgagctgatggagatcctggatgggatggaccagagccaccgcaaggagatgcagctgtacaacagcatcttcagcctgctcagcttcgagaagattggctacacagaggtccagttccggccgtaccgcacagacgacttcatcacgcgcctgtactatgagacgcccaggttcacagtgctgaaccagacgtgggtcctgaaggctcgagtcaacgactcggagcgtaaccccaacctgtcctgcaagcgtacgctctccttccagctcctcctcaagagcaaggtcacggcaccgctggagtgctccttcctgctgctcaagggcccctacgacgacgtgaggatcagccccgtcatctaccactttgtcttcaccaacgagagcaacgagacggactacgtgccactgcccatcattgactccgtggagtgcaacaagctgctggctgccaagaacatcaacctgcggctcttcctgttccagatacagaagtagggcggggcctcaggatgtccgaggagcccacgggcggcatcccagcaccgctgccctgtccacctggctggcagctgcttcacaggactatctgatcactttagcaaaggaggagaacaaacgaagccaacacagggcaagtctgcatgcgtgcgcgacggggcccccgcctccggctcacccccccgacccctgcctcccctccttccgagggccgccagaggctgggctgacccgaagaggagacggtgcaccaggcgccccgaggctcagagacggtggcagcaaggaggccgagaggcacagcgaccctgccccagcccttctgtgcagtcaggcggcggtgctgctccatccctgcgggttccggcggggcgcgggggccttgctgacatcagacgggatatccgaatatctgatagcaattaaaaggcagccttgtttcgt

SEQ ID NO: 70 - DNA, 1212 bp, Homo sapiens
cgctcgctcccgcaactgggggcacggcagaggaggcagggccgacggcggtgggcggtgcgttgcgcaggctcgggcctcccgctcgccgctgcgttgggaccgcgcagcccggtgtgtgcagtggcctcagggatccggaaagtctaggactgaacttctcctaacatccagtaatggggacctggaacctgggcttactagagtgccgcgcgtagggctccaggtcgctggcttctgcgcttccttcctctccaaagttgagtatctcctatctgtgtcctcgtacatactgccgcctgaggtgccatggcccccaagccgggggccgagtggagcacagccctgtcccatctggtgctgggagtggtgtctctgcacgcagccgtgagcacagccgaggcaagtcgaggggctgctgctggcttcctgctccaggtcttggctgccaccaccacgctggccccagggctgagcacacacgaagactgccttgctggagcctgggtggccaccgtcatcggccttccccttctggccttcgatttccactgggtgaatggggaccgctcctctgccaacctgctcctgggaggaggcatggtgctggcagtggctggcggccacctcggccctgagggccgctctgtggctggtcaggcaatgctgttggtggtcgcagtgaccatcctcattgtagctgtcttcacggccaacacttatgggatgtgggggggggcgatgctgggtgtggcaggcctcctgagccggctggaggaggacaggctgctgctgctaccgaaggaggatgtctgtcgctgggccttggctgtaggcagctgggcttactgccgggccctgcatacacagcgcctccagtgggagtgacagttggatacagccaggcagggtttctgccctgccgaacactttccctcccacctgcctgctcctggcgccttctccctaggggtagactcttctgcctactgaagtgggtttgctgcacattgactggtcaggggcagagtctgggtgctgtcctttggccacgtgtggggacttgtctagaccagaatgaaagggacagggtcccagacacgtttgggggtcctgattctgggctggacacggttgtggatccagagaagaggcctagtctccaataaatcttaggaattttgcaggaatatgaaaaaaaaaaaaaaaaaa

SEQ ID NO: 71 - DNA, 1176 bp, Homo sapiens
cccaaacagagcgttttctggtccccgagctcctcccgaccccacccgctcctacggcctccaaccggccccccccaggtgtgtgcagtggcctcagggatccggaaagtctaggactgaacttctcctaacatccagtaatggggacctggaacctgggcttactagagtgccgcgcgtagggctccaggtcgctggcttctgcgcttccttcctctccaaagttgagtatctcctatctgtgtcctcgtacatactgccgcctgaggtgccatggcccccaagccgggggccgagtggagcacagccctgtcccatctggtgctgggagtggtgtctctgcacgcagccgtgagcacagccgaggcaagtcgaggggctgctgctggcttcctgctccaggtcttggctgccaccaccacgctggccccagggctgagcacacacgaagactgccttgctggagcctgggtggccaccgtcatcggccttccccttctggccttcgatttccactgggtgaatggggaccgctcctctgccaacctgctcctgggaggaggcatggtgctggcagtggctggcggccacctcggccctgagggccgctctgtggctggtcaggcaatgctgttggtggtcgcagtgaccatcctcattgtagctgtcttcacggccaacacttatgggatgtgggggggggcgatgctgggtgtggcaggcctcctgagccggctggaggaggacaggctgctgctgctaccgaaggaggatgtctgtcgctgggccttggctgtaggcagctgggcttactgccgggccctgcatacacagcgcctccagtgggagtgacagttggatacagccaggcagggtttctgccctgccgaacactttccctcccacctgcctgctcctggcgccttctccctaggggtagactcttctgcctactgaagtgggtttgctgcacattgactggtcaggggcagagtctgggtgctgtcctttggccacgtgtggggacttgtctagaccagaatgaaagggacagggtcccagacacgtttgggggtcctgattctgggctggacacggttgtggatccagagaagaggcctagtctccaataaatcttaggaattttgcaggaatatgaaaaaaaaaaaaaaaaaa

SEQ ID NO: 72 - protein, 362 aa, Homo sapiens
MAPKPGAEWSTALSHLVLGVVSLHAAVSTAEASRGAAAGFLLQVLAATTTLAPGLSTHEDCLAGAWVATVIGLPLLAFDFHWCTNGHLMCAGCFIHLLADARLKEEQATCPNCRCEISKSLCCRNLAVEKAVSELPSECGFCLRQFPRSLLERHQKEECQDRVTQCKYKRIGCPWHGPFHELTVHEAACAHPTKTGSELMEILDGMDQSHRKEMQLYNSIFSLLSFEKIGYTEVQFRPYRTDDFITRLYYETPRFTVLNQTWVLKARVNDSERNPNLSCKRTLSFQLLLKSKVTAPLECSFLLLKGPYDDVRISPVIYHFVFTNESNETDYVPLPIIDSVECNKLLAAKNINLRLFLFQIQK

SEQ ID NO: 73 - protein, 192 aa, Homo sapiens
MAPKPGAEWSTALSHLVLGVVSLHAAVSTAEASRGAAAGFLLQVLAATTTLAPGLSTHEDCLAGAWVATVIGLPLLAFDFHWVNGDRSSANLLLGGGMVLAVAGGHLGPEGRSVAGQAMLLVVAVTILIVAVFTANTYGMWGGAMLGVAGLLSRLEEDRLLLLPKEDVCRWALAVGSWAYCRALHTQRLQWE

SEQ ID NO: 74 - protein, 192 aa, Homo sapiens; identical to SEQ ID NO: 73

SEQ ID NO: 75 - DNA, 726 bp, Homo sapiens
gcccaggtgaaactgctcgagtctggcgcaggactcttgaagccttcggagaccctgtccctcacctgcgctgtttatggtgactccttcggtggtcaccactggagctggatccgccagccccctgggaagggactagagtggatcggcgaaataaattttcttggcaacaccaattacaatccgtccctcaagagtcgagtcgccatatcaaaggacacgtcaaaaaatcaattctccctgaccttgaattctgcgaccgccgcggacacggcagtctacttctgtgcgcgacgggaaactatggctagtcgaaagagggcttttgacatctggggccaggggacaatggtcactgtctctgcagcttccaccaagggcccatcggtcttccccctggcgccctgctccaggagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgagcgtgccctccagcaacttgggcacccagacctacacctgcaacgtgaatcacaagcccagcaacaccaaggtggacaagacagttgagctcaaaaccccacttggtgacacaactcacacatgcccacggtgcccagtgcccaaatcttgt

SEQ ID NO: 76 - DNA, 408 bp, Homo sapiens
cgggtgcagctgatgcagtctggggctgaggtgaggaagcatggggcctcagtgaaggtttcctgcaaggcgtctggatacagcttcggcaactactttatgcattggctacgacaggccccaggacaagggcctgagtggatgggaatgatcaaccccagggacaataaggcaaactacgcacagaagtttcggggcagagtcaccatgaccaaggacacgtccacgagtatcttctacatggagttgagcagactgagatctgatgacacggccgtatatttttgtgcgagagatatgggttcgcacgacttttgggcggtgggcctgaacctacctgggagcttgtttgacaactggggccagggaaccctggtcaccgtctcctcagcttccaccaagggccca

SEQ ID NO: 77 - DNA, 1134 bp, Homo sapiens
gcaagcttcaagggcccatcggtcttccccctggcgccctgctccaggagcacccctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacacctgcaacgtgaatcacaagcccagcaacaccaaggtggacaagagagttgagctcaaaaccccacttggtgacacaactcacacatgcccacggtgcccagagcccaaatcttgtgacacacctcccccgtgcccacggtgcccagagcccaaatcttgtgacacacctcccccatgcccacggtgcccagagcccaaatcttgtgacacacctcccccgtgcccaaggtgcccagcacctgaactcctgggaggaccgtcagtcttcctcttccccccaaaacccaaggatacccttatgatttcccggacccctgaggtcacgtgcgtggtggtggacgtgagccacgaagaccccgaggtccagttcaagtggtacgtggacggcgtggaggtgcataatgccaagacaaagccgcgggaggagcagtacaacagcacgttccgtgtggtcagcgtcctcaccgtcctgcaccaggactggctgaacggcaaggagtacaagtgcaaggtctccaacaaagccctcccagcccccatcgagaaaaccatctccaaaaccaaaggacagccccgagaaccacaggtgtacaccctgcccccatcccgggaggagatgaccaagaaccaggtcagcctgacctgcccggtcaaaggcttctaccccagcgacatcgccgtggagtgggagagcagcgggcagccggagaacaactacaacaccacgcctcccatgctggactccgacggctccttcttcctctacagcaagctcaccgtggacaagagcaggtggcagcaggggaacatcttctcatgctccgtgatgcatgaggctctgcacaaccgcttcacgcagaagagcctctccctgtctccgggtaaatga

SEQ ID NO: 78 - protein, 242 aa, Homo sapiens
AQVKLLESGAGLLKPSETLSLTCAVYGDSFGGHHWSWIRQPPGKGLEWIGEINFLGNTNYNPSLKSRVAISKDTSKNQFSLTLNSATAADTAVYFCARRETMASRKRAFDIWGQGTMVTVSAASTKGPSVFPLAPCSRSTSGGTAALGCLVKDYFPEPVTVSWNSGALTSGVHTFPAVLQSSGLYSLSSVVSVPSSNLGTQTYTCNVNHKPSNTKVDKTVELKTPLGDTTHTCPRCPVPKSC

SEQ ID NO: 79 - protein, 136 aa, Homo sapiens
RVQLMQSGAEVRKHGASVKVSCKASGYSFGNYFMHWLRQAPGQGPEWMGMINPRDNKANYAQKFRGRVTMTKDTSTSIFYMELSRLRSDDTAVYFCARDMGSHDFWAVGLNLPGSLFDNWGQGTLVTVSSASTKGP

SEQ ID NO: 80 - protein, 377 aa, Homo sapiens
ASFKGPSVFPLAPCSRSTPGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCPVKGFYPSDIAVEWESSGQPENNYNTTPPMLDSDGSFFLYSKLTVDKSRWQQGNIFSCSVMHEALHNRFTQKSLSLSPGK

What is claimed is:

1. A method for predicting the risk of pre-term birth in a pregnant subject, the method comprising:
   (a) providing a sample from the pregnant subject;
   (b) enriching the sample in (a) for exosomes;
   (c) detecting a level of transthyretin (TTR) in the sample of (b);
   (d) detecting a level of one or both of collagen type XXVII α1 (COL27A1) and growth arrest-specific protein 1 (GAS1) in the sample of (b); and
   (e) identifying a subject having an elevated level of two or more of TTR, COL27A1, and GAS1, compared to a threshold level(s) as having an increased risk of pre-term birth.

2. A method of decreasing the risk of pre-term birth in a pregnant subject, the method comprising:
   (a) providing a sample from a pregnant subject;
   (b) enriching the sample in (a) for exosomes;
   (c) detecting a level of transthyretin (TTR) in the sample of (b);
   (d) detecting a level of one or both of collagen type XXVII α1 (COL27A1) and growth arrest-specific protein 1 (GAS1) in the sample of (b); and
   (e) administering a therapeutic treatment to a pregnant subject having an elevated level of two or more of TTR, COL27A1, and GAS1, compared to a threshold level.

3. The method of claim 1, wherein the subject has had at least one pre-term birth.

4. The method of claim 1, wherein the subject is human and the sample in (a) is obtained from the subject within the second trimester of gestation or the third trimester of gestation.

5. The method of claim 1, wherein the subject is human and the sample in (a) is obtained from the subject within the first trimester of gestation.

6. The method of claim 1, wherein the sample comprises serum, plasma, amniotic fluid, vaginal secretion, urine, or saliva.

7. The method of claim 2, wherein said therapeutic treatment is selected from the group consisting of: complement inhibitors, hormone treatment, steroid treatment, passive immunotherapy with intravenous immunoglobulins, aspirin, and tumor necrosis factor (TNF)-α antagonists.

8. The method of claim 1, wherein the sample in (a) comprises serum.

9. The method of 1, wherein the sample in (a) comprises plasma.

10. The method of claim 1, wherein detecting the level of TTR in the sample of (c) and detecting the level of one or both of COL27A1 and GAS1 in the sample of (d) is performed using mass spectrometry.

11. The method of claim 8, wherein the subject is human and the sample in (a) is obtained from the subject at 15 to 17 weeks of gestation.

12. The method of claim 1, wherein the subject is human and the sample in (a) is obtained from the subject within 15 weeks of gestation.

13. The method of claim 2, wherein the subject has had at least one pre-term birth.

14. The method of claim 2, wherein the subject is human and the sample in (a) is obtained from the subject within the second trimester of gestation or the third trimester of gestation.

15. The method of claim 2, wherein the subject is human and the sample in (a) is obtained from the subject within the first trimester of gestation.

16. The method of claim 2, wherein the sample comprises serum, plasma, amniotic fluid, vaginal secretion, urine, or saliva.

17. The method of claim 2, wherein the sample in (a) comprises serum.

18. The method of 2, wherein the sample in (a) comprises plasma.

19. The method of claim 2, wherein detecting the level of TTR in the sample of (c) and detecting the level of one or both of COL27A1 and GAS1 in the sample of (d) is performed using mass spectrometry.

20. The method of claim 17, wherein the subject is human and the sample in (a) is obtained from the subject at 15 to 17 weeks of gestation.

21. The method of claim 1, further comprising:
detecting a level of one or more of ALL1-fused gene from chromosome 4 protein (AR4)/Fragile X Mental Retardation 2 (FMR2) family member 3 (AFF3), ryanodine receptor 1 (RYR1), E26 transformation specific variant 6 (ETV6), claudin-10, zinc finger protein 23 (ZNF23), Kazrin isoform-1, keratin-associated protein 10-9 (KRTAP10-9), Huntingtin (HTT), microtubule associated protein 9 (MAP9), coiled-coil domain-containing protein 13 (CCDC13), inositol hexakisphosphate and diphosphoinositol-pentakisphosphate kinase isoform 2 (HISPPD1), immunoglobulin gamma-3 chain C (IGHG3), and cysteine- and histidine-rich protein-1 (CYHR1) in the sample of (b); and
further identifying a subject having an elevated level of one or more of AFF3, RYR1, ZNF23, Kazrin isoform-1, KRTAP10-9, HTT, IGHG3, and CYHR1 compared to a threshold level, or a decreased level of one or more of ETV6, claudin-10, MAP9, CCDC13, and HISPPD1 compared to a threshold level as having an increased risk of pre-term birth.

22. The method of claim 1, wherein the method comprises detecting a level of COL27A1 in the sample of (b).

23. The method of claim 2, further comprising:
detecting a level of one or more of ALL1-fused gene from chromosome 4 protein (AR4)/Fragile X Mental Retardation 2 (FMR2) family member 3 (AFF3), ryanodine receptor 1 (RYR1), E26 transformation specific variant 6 (ETV6), claudin-10, zinc finger protein 23 (ZNF23), Kazrin isoform-1, keratin-associated protein 10-9 (KRTAP10-9), Huntingtin (HTT), microtubule associated protein 9 (MAP9), coiled-coil domain-containing protein 13 (CCDC13), inositol hexakisphosphate and diphosphoinositol-pentakisphosphate kinase isoform 2 (HISPPD1), immunoglobulin gamma-3 chain C (IGHG3), and cysteine- and histidine-rich protein-1 (CYHR1) in the sample of (b); and
further administering a therapeutic treatment to a pregnant subject having an elevated level of one or more of AFF3, RYR1, ZNF23, Kazrin isoform-1, KRTAP10-9, HTT, IGHG3, and CYHR1 compared to a threshold level, or a decreased level of one or more of ETV6, claudin-10, MAP9, CCDC13, and HISPPD1 compared to a threshold level.

24. The method of claim 2, wherein the method comprises detecting a level of COL27A1 in the sample of (b).

* * * * *